United States Patent
Rotem et al.

(10) Patent No.: US 11,466,247 B2
(45) Date of Patent: Oct. 11, 2022

(54) BACTERIAL GENES AND ISOLATES FOR CONFERRING INSECT RESISTANCE

(71) Applicants: Evogene Ltd., Rehovot (IL); Marrone Bio Innovations, Inc., Davis, CA (US)

(72) Inventors: Or Rotem, Rehovot (IL); Pamela G. Marrone, Davis, CA (US); Sharon Ayal, Kibbutz Bet Nir (IL); Amit Vasavada, Poway, CA (US); Brittany Pierce, Davis, CA (US); Lisa N. Meihls, St. Ann, MO (US); Vaka S. Reddy, Bridgeton, MO (US); Debora Wilk, Woodland, CA (US); Ana-Lucia Cordova-Kreylos, Woodland, CA (US); James Presnail, Saint Louis, MO (US); Eyal Emmanuel, Rehovot (IL)

(73) Assignees: Evogene Ltd., Rehovot (IL); Marrone Bio Innovations, Inc., Davis, CA (US)

( * ) Notice: Subject to any disclaimer, the term of this patent is extended or adjusted under 35 U.S.C. 154(b) by 0 days.

(21) Appl. No.: 16/648,771

(22) PCT Filed: Sep. 17, 2018

(86) PCT No.: PCT/IL2018/051057
§ 371 (c)(1),
(2) Date: Mar. 19, 2020

(87) PCT Pub. No.: WO2019/058377
PCT Pub. Date: Mar. 28, 2019

(65) Prior Publication Data
US 2020/0283484 A1    Sep. 10, 2020

Related U.S. Application Data

(60) Provisional application No. 62/560,254, filed on Sep. 19, 2017.

(51) Int. Cl.
| | | |
|---|---|---|
| *C12N 1/20* | (2006.01) | |
| *A01N 63/28* | (2020.01) | |
| *A01N 63/20* | (2020.01) | |
| *A01N 63/23* | (2020.01) | |
| *A01N 63/22* | (2020.01) | |
| *C07K 14/195* | (2006.01) | |
| *C07K 14/32* | (2006.01) | |
| *C07K 14/36* | (2006.01) | |
| *C12N 15/01* | (2006.01) | |
| *C12N 15/82* | (2006.01) | |
| *A01N 63/50* | (2020.01) | |
| *C12R 1/01* | (2006.01) | |
| *C12R 1/07* | (2006.01) | |

(Continued)

(52) U.S. Cl.
CPC .............. *C12N 1/20* (2013.01); *A01N 63/20* (2020.01); *A01N 63/22* (2020.01); *A01N 63/23* (2020.01); *A01N 63/28* (2020.01); *A01N 63/50* (2020.01); *C07K 14/195* (2013.01); *C07K 14/32* (2013.01); *C07K 14/36* (2013.01); *C12N 1/205* (2021.05); *C12N 15/01* (2013.01); *C12N 15/8286* (2013.01); *C12R 2001/01* (2021.05); *C12R 2001/07* (2021.05); *C12R 2001/075* (2021.05); *C12R 2001/125* (2021.05); *C12R 2001/465* (2021.05)

(58) Field of Classification Search
None
See application file for complete search history.

(56) References Cited

U.S. PATENT DOCUMENTS

2011/0118125 A1    5/2011    Zhu et al.

FOREIGN PATENT DOCUMENTS

| JP | 2014-023502 | 2/2014 |
|---|---|---|
| KR | 2005-040154 | 5/2005 |

(Continued)

OTHER PUBLICATIONS

Michel Drancourt, Claude Bollet, Antoine Carlioz, Rolland Martelin, Jean-Pierre GAYRAL,2 and Didier Raoult, 16S Ribosomal DNA Sequence Analysis of a Large Collection of Environmental and Clinical Unidentifiable Bacterial Isolates, Journal of Clinical Microbiology, Oct. 2000, p. 3623-3630. (Year: 2000).*

(Continued)

*Primary Examiner* — Weihua Fan
*Assistant Examiner* — Brian James Sullivan
(74) *Attorney, Agent, or Firm* — Rodney J. Fuller; Booth Udall Fuller, PLC

(57) ABSTRACT

Provided are biologically pure bacterial isolates characterized by a genome structure at least 90% similar to a genome structure of a bacterial species selected from the group consisting of: *Streptomyces* sp. E128 having an NRRL Accession No. B-67462, *Bacillus amyloliquefaciens* A190 having an NRRL Accession No. B-67464, *Bacillus subtilis* P243 having an NRRL Accession No. B-67459, *Bacillus thuringiensis* M979 having an NRRL Accession No. B-67457, *Massilia aurea* P63 having an NRRL Accession No. B-67461, *Rhodococcus* sp. G706, *Stenotrophomonas maltophilia* E132 having an NRRL Accession No. B-67460, *Streptomyces aurantiacus* A918, *Streptomyces badius* O180, *Streptomyces mirabilis* B670 having an NRRL Accession No. B67463, *Streptomyces scopuliridis* F427 having an NRRL Accession No. B-67458, and *Streptomyces* sp. L219. Also provided are whole cell broth or lysates thereof, and polynucleotide, polypeptides and constructs expressing same, compositions-of-matter comprising same and methods using same for killing or inhibiting the development of insects.

Figure 1A:
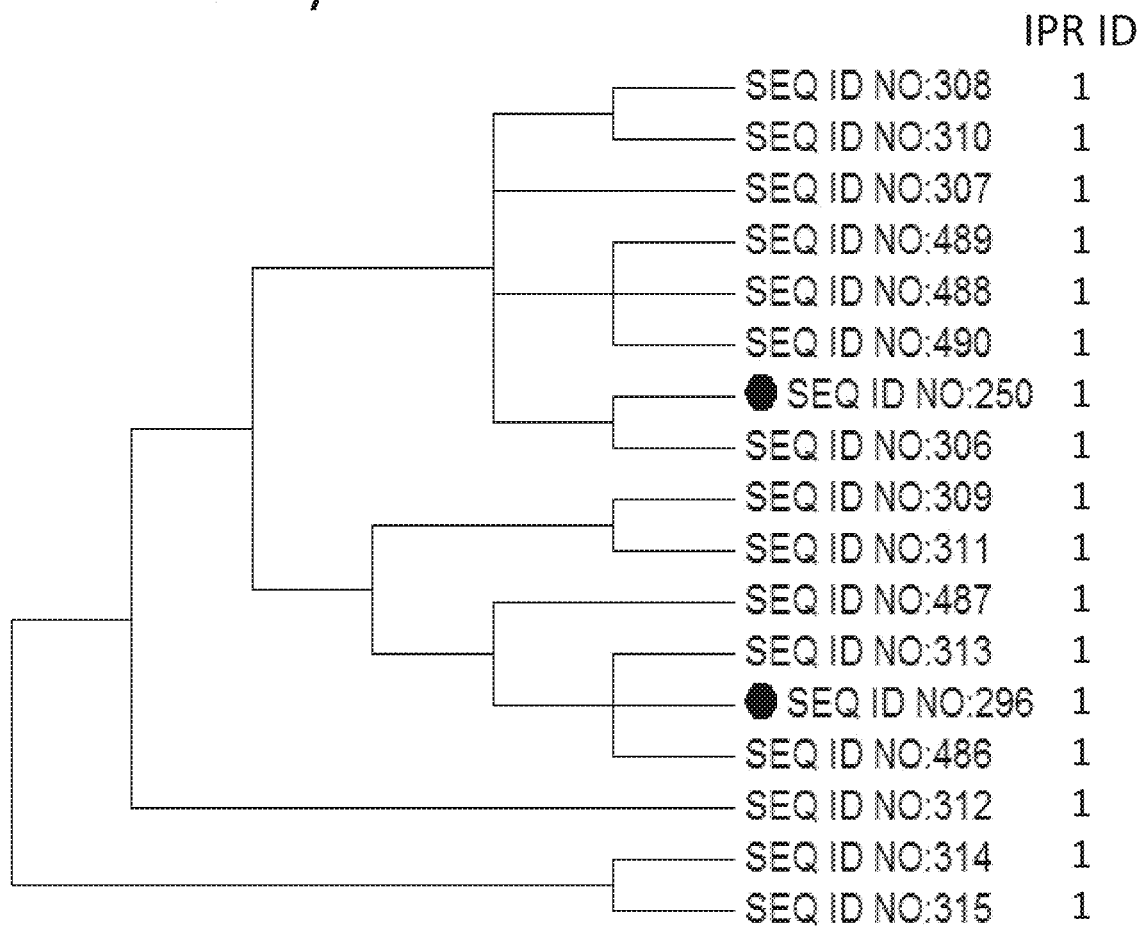

6 Claims, 10 Drawing Sheets
Specification includes a Sequence Listing.

(51) Int. Cl.
  C12R 1/125  (2006.01)
  C12R 1/465  (2006.01)

(56) References Cited

FOREIGN PATENT DOCUMENTS

| WO | WO 01/79450 | 10/2001 |
| WO | WO 2014/124361 | 8/2014 |
| WO | WO 2019/058377 | 3/2019 |

OTHER PUBLICATIONS

Guiming Liu, Bacillus thuringiensis is a Gram-positive bacterium that produces intracellular protein crystals toxic to a wide variety of insect larvae. Genome Announcements, Genome Announcements, Mar. 2013 (Year: 2013).*
Christopher A. Dunlap, Soo-Jin Kim, Soon-Wo Kwon, and Alejandro P. Rooney, Bacillus velezensis is not a later heterotypic synonym of Bacillus amyloliquefaciens, International Journal of Systematic and Evolutionary Ecology, (2016), 66, 1212-1217. (Year : 2016).*
Drancourt, 16S Ribosomal DNA Sequence Analysis of a Large Collection of Environmental and Clinical Unidentifiable Bacterial Isolates, Oct. 2000, Journal of Clinical Microbiology, p. 3623-3630 (Year: 2000).*
Hypothetical protein BU198_35290 [*Streptomyces* sp. CBMA156], GenBank: MBD0675820.1, https://www.ncbi.nlm.nih.gov/protein/MBD0675820.1?report=genbank&log$=protalign&blast_rank=1&RID=J7PFCUKJ013, Dec. 22, 2016 (Year: 2016).*
International Search Report and the Written Opinion dated Dec. 25, 2018 from the International Searching Authority Re. Application PCT/IL2018/051057. (17 pages).
Invitation to Pay Additional Fees and Communication Relating to the Results of the Partial International Search dated Nov. 13, 2018 From the International Searching Authority Re. Application No. PCT/IL2018/051057. (3 Pages).
Bel et al. "Comprehensive Analysis of Gene Expression Profiles of the Beet Armyworm *Spodoptera exigua* Larvae Challenged With Bacillus Thuringiensis Vip3Aa Toxin", PLOS ONE, 8(12): e81927-1-e81927-23, Dec. 2, 2013.
Cardinale et al. "Paradox of Plant Growth Promotion Potential of Rhizobacteria and Their Actual Promotion Effect on Growth of Barley (*Hordeum vulgare* L.) Under Salt Stress," Microbiological Research 181: 22-32, 2015.
Cardinale et al. "*Streptomyces* sp. E128 16S Ribosomal RNA Gene, Partial Sequence," GenBank Accession No. KR703562.1, 1 page, Aug. 7, 2015.
Ishida et al. "Agrobacterium-Mediated Transformation of Maize", Nature Protocols, 2(7): 1614-1621, Published Online Jun. 21, 2007.
James "Global Status of Commercialized Biotech/GM Crops: 2014", ISAAA Briefs, International Service for the Acquisition of Agri-Biotech Applications, Brief 49: 1-259, 2014.
Lim et al. "A Novel *Streptomyces* sp. Lim6 Having Protecting Ability for Riceblast Disease. GenBank Accession No. DI096350.1" 2 pages, Feb. 21, 2008.
Mehling "Streptomyces Galbus 16S rRNA Gene, Strain DSM40089," European Nucleotide Archive Online, Sequence: X79852.1, 2 pages, Jun. 27, 1994.
Palma et al. "Bacillus Thuringiensis Toxin: An Overview of Their Biocidal Activity", Toxins, 6(12): 3296-3325, Published Online Dec. 11, 2014.
Paz et al. "Improved Cotyledonary Node Method Using An Alternative Explant Derived From Mature Seed for Efficient Agrobacterium-Mediated Soybean Transformation", Plant Cell Reports, 25(3): 206-213, Published Online Oct. 25, 2005.
Rigden et al. "The PA14 Domain, A Conserved All-Beta Domain in Bacterial Toxins, Enzymes, Adhesins and Signaling Molecules", Trends in Biochemical Sciences, 29(7): 335-339, Available Online Jun. 7, 2004.
Sumitani et al. "JP 2014023502-A/2: A new Amylase. GenBank Accession No. HW429891.1", 2 pages, May 28, 2014.
Tamura et al. Streptomyces Galbus Gene for 16S rRNA, Partial Sequence, Strain: NBRC 12864., European Nucleotide Archive Online, Sequence: AB184201.1, 2 pages, Apr. 1, 2006.
Zhong et al. "The Chitinase C Gene PsChiC From *Pseudomonas* Sp. and Its Synergistic Effects on Larvicidal Activity", Genetics and Molecular Biology, 38(3): 366-372, Published Online Aug. 21, 2015.
Supplementary Partial European Search Report and the European Provisional Opinion dated Jun. 7, 2021 From the European Patent Office Re. Application No. 18858765.3. (21 Pages).
Cardinale et al. "Paradox of Plant Growth Promotion Potential of Rhizohacteria and Their Actual Promotion Effect on Growth of Barley (*Hordeum vulgare* L.) Under Salt Stress", Appendix A: Supplementary Data, Microbiological Research, XP055806069, p. 1-13, Available Online Aug. 7, 2015.
Schnepf et al. "Bacillus Thuringiensis and Its Pesticidal Crystal Proteins", Microbiology and Molecular Biology Reviews, XP000986964, 62(3): 775-806, Sep. 1, 1998.
Xu et al. "A Novel Insecticidal Peptide SLP1 Produced by Streptomyces Laindensis H008 Against Lipaphis Erysimi", Molecules, XP055806554, 21(8): 1101-1-1101-10, Aug. 22, 2016.
Extended European Search Report and the European Provisional Opinion dated Sep. 7, 2021 From the European Patent Office Re. Application No. 18858765.3. (17 Pages).

* cited by examiner

BACTERIAL GENES AND ISOLATES FOR CONFERRING INSECT RESISTANCE

RELATED APPLICATIONS

This application is a National Phase of PCT Patent Application No. PCT/IL2018/051057 having International filing date of Sep. 17, 2018, which claims the benefit of priority under 35 USC § 119(e) of U.S. Provisional Patent Application No. 62/560,254 filed on Sep. 19, 2017. The contents of the above applications are all incorporated by reference as if fully set forth herein in their entirety.

SEQUENCE LISTING STATEMENT

The ASCII file, entitled 80265SequenceListing.txt, created on Mar. 19, 2020, comprising 3,371,578 bytes, submitted concurrently with the filing of this application is incorporated herein by reference. The sequence listing submitted herewith is identical to the sequence listing forming part of the international application.

FIELD AND BACKGROUND OF THE INVENTION

The present invention, in some embodiments thereof, relates to biologically pure bacterial isolates, whole cell broth or lysates thereof, polynucleotides, polypeptides and constructs expressing same, compositions comprising same and methods using same for killing or inhibiting the development of insects.

In modern agriculture, there is a recognized need for elimination of pests from plant fields without exposing the plants to toxic compounds which cause undesirable agronomic issues.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel.

Insect pests are a major factor in the loss of the world's agricultural crops. For example, armyworm feeding, black cutworm damage, or European corn borer damage can be economically devastating to agricultural producers. Insect pest-related crop loss from European corn borer attacks on field and sweet corn alone has reached about one billion dollars a year in damage and control expenses.

Insects are considered a major cause of damage to field crops in infested areas. For example, Cabbage looper (*Trichoplusia ni*) is a destructive crop pest in North America. During the larval stage, the pest eats three-times its body weight in plant material a day. Thus, once established in a crop field, the cabbage looper is difficult to be controlled.

Beet armyworm (*Spodoptera exigua*) is a widespread pest for a numerous types of crops that is difficult to control. The larvae are voracious eaters that defoliate host plants. Older instars can also burrow into the plants. The dam age to the host plant renders it unmarketable.

The Western tarnished plant bug (*Lygus hesperus*) is a serious pest of cotton, strawberries, and seed crops such as alfalfa. For example, only in California it causes a damage accounting to about 30 million USD (United States Dollar) each year in cotton plants, and in at least 40 million USD in losses to the USA strawberry industry.

Diamondback Moth (*Plutella xylostella*), also called cabbage moth, is a European moth that has since spread worldwide. The moth affects cruciferous crops in the world and usually only feeds on plants that produce glucosinolates.

Fall armyworm (*Spodoptera frugiperda*) is part of the order of Lepidoptera which mainly attacks maize crops, and is capable of completely destroying maize fields.

Western corn rootworm (*Diabrotica virgifera virgifera*) is one of the most devastating corn rootworm species in North America. Corn rootworm larvae can destroy significant percentages of corn if left untreated. In the United States, current estimates show that 30,000,000 acres of corn are infested with corn rootworm, causing about 1 billion USD in lost revenue each year.

Green Peach Aphid (*Myzus persicae*) is the most significant aphid pest of peach trees worldwide, causing decreased growth, shriveling of the leaves and the death of various tissues. It is also hazardous because it acts as a vector for the transport of plant viruses to various crops. In the warmer months, and throughout the year in warmer climates, the green peach aphid reproduces asexually; adults produce nymphs on a wide variety of herbaceous plant material, including many vegetable crops such as cabbage and its *Brassica* relatives, potato and other crops of the family solanaceae, celery, mustard, pepper, pumpkin, okra, corn, and sunflower and other flower crops. Herbaceous weeds, such as white goosefoot and common tumble weed also act as hosts. While the green peach aphid has developed resistance to various pesticides, many of its natural enemies can be used as biological control agents in certain crops, such as ladybirds (Coccinellidae) in radish crops, and the wasp Diaeretiella rapae in broccoli.

Soybean Looper (*Chrysodeixis includens*) is a moth of the Noctuidae family, widely spread from Southern Quebec and Southern Ontario through the eastern and southern part of the United States to Central America and South America, the Antilles and the Galapagos Islands. The larvae feed on a wide range of plants such as Asteraceae, Brassicaceae, Commelinaceae, Euphorbiaceae, Fabaceae, Geraniaceae, Lamiaceae, Lauraceae, Malvaceae, Solanaceae, Verbenaceae, *Medicago saliva, Phaseolus polystachios, Glycine max, Gossypium herbaceum, Nicotiana tabacum, Lycopersicum esculentum, Brassica* and *Lactuca sativa*.

Twospotted spider mite (*Tetranychus urticae*) is a small insect which feeds on the underside of foliage of a variety of plants including shade trees, food crops such as peppers, tomatoes, potatoes, beans, maize, and strawberries, and ornamental plants, shrubs and flowers such as roses. The adult female has eight legs and has a pale yellowish or greenish color. The females lay eggs on the underside of leaves at the rate of 2-6 a day, with an average of 100 eggs in a lifetime. While a complete generation of the insect takes about 7-20 days, various generations may overlap and all stages can be found on most host plants during the summer months. The twospotted spider mite causes damage to the plants by sucking plant fluid from the foliage, which may be chlorotic, stippled, or mottled in appearance. Although the individual lesions are very small, attack by hundreds or thousands of spider mites can cause thousands of lesions, and thus can significantly reduce the photosynthetic capability of plants. A known biological control for this insect is the mite's natural predator, *Phytoseiulus persimilis*.

While intensive application of synthetic chemical insecticides was relied upon as the pest control agent in agriculture using broad-spectrum chemical insecticides, concerns were raised for the potential use of hazardous pesticides on the environment and of human health. Accordingly, regulators have banned or limited the use of some of the more hazardous pesticides that were traditionally employed on plant fields. In addition, emerging insect resistance issues stimulated the research and development of biological pesticides, including the discovery and use of various entomopathogenic bacteria.

Biological control of insect pests of agricultural significance using a microbial agent, such as fungi, bacteria, or another species of insect affords an environmentally friendly and commercially attractive alternative to synthetic chemical pesticides. Thus, the use of biopesticides presents a lower risk of pollution and environmental hazards, and biopesticides provide greater target specificity as compared to traditional broad-spectrum chemical insecticides. In addition, biopesticides often cost less to produce and thus improve economic yield for a wide variety of crops.

The control paradigm shifted for using entomopathogenic bacteria, especially bacteria belonging to the genus *Bacillus*, as a biological pest control agents. Strains of the bacterium *Bacillus thuringiensis* (Bt) have been used as a source for insecticidal proteins since it was discovered that Bt strains show a high toxicity against specific insects. Bt strains are known to produce delta-endotoxins that are localized within parasporal crystalline inclusion bodies at the onset of sporulation and during the stationary growth phase, and are also known to produce secreted insecticidal proteins. Upon ingestion by a susceptible insect, delta-endotoxins as well as secreted toxins exert their effects at the surface of the midgut epithelium, disrupting the cell membrane, leading to cell disruption and death. Genes encoding insecticidal proteins have also been identified in bacterial species other than Bt, including other *Bacillus* and a diversity of other bacterial species, such as *Brevibacillus laterosporus, Lysinibacillus sphaericus* and *Paenibacillus popilliae*. Insect pathogenicity has also been attributed to strains of *B. larvae, B. lentimorbus, B. sphaericus* and *B. cereus*.

Crop plants have been developed with enhanced insect resistance by genetically engineering crop plants to produce pesticidal proteins from *Bacillus*. These genetically engineered crops are now widely used in American agriculture and have provided producers with an environmentally friendly alternative to traditional insect-control methods. For example, in 2012, 26.1 million hectares were planted with transgenic crops expressing Bt toxins (James, C. "Global Status of Commercialized Biotech/GM Crops: 2012". ISAAA Brief No. 44). However, while they have proven to be very successful commercially, these genetically engineered, insect-resistant (or insect-protected) crop plants typically provide resistance to only a narrow range of economically important pests.

In addition, the global use of transgenic insect-protected crops and the limited variety of insecticidal proteins used in these crops has created a selection pressure for existing insect alleles that impart resistance to the currently-utilized insecticidal proteins. Due to the development of resistance in target pests to insecticidal proteins there is a continuing need for discovery and development of new forms of insecticidal proteins that are useful for managing the increase in insect resistance to transgenic crops expressing insecticidal proteins. New insecticidal proteins with improved efficacy and which exhibit control over a broader spectrum of susceptible insect pest species will reduce the number of surviving insect pests which can develop resistance alleles. In addition, the use in one plant of two or more transgenic insecticidal proteins toxic to the same insect pest and displaying different modes of action reduces the probability of resistance in any single target insect pest species.

SUMMARY OF THE INVENTION

According to an aspect of some embodiments of the present invention there is provided a biologically pure bacterial isolate comprising a bacterial strain selected from the group consisting of:

*Bacillus amyloliquefaciens* A190 strain having an NRRL Accession No. B-67464 or a functionally homologous strain,

*Bacillus subtilis* P243 strain having an NRRL Accession No. B-67459 or a functionally homologous strain,

*Bacillus thuringiensis* M979 strain having an NRRL Accession No. B-67457 or a functionally homologous strain,

*Massilia aurea* P63 strain having an NRRL Accession No. B-67461 or a functionally homologous strain,

*Rhodococcus* sp. G706 strain or a functionally homologous strain,

*Stenotrophomonas maltophilia* E132 strain having an NRRL Accession No. B-67460 or a functionally homologous strain,

*Streptomyces aurantiacus* A918 strain or a functionally homologous strain,

*Streptomyces badius* O180 strain or a functionally homologous strain,

*Streptomyces mirabilis* B670 strain having an NRRL Accession No. B67463 or a functionally homologous strain,

*Streptomyces scopuliridis* F427 strain having an NRRL Accession No. B-67458 or a functionally homologous strain,

*Streptomyces* sp. E128 strain having an NRRL Accession No. B-67462 or a functionally homologous strain, and

*Streptomyces* sp. L219 strain or a functionally homologous strain.

According to an aspect of some embodiments of the present invention there is provided a biologically pure bacterial isolate characterized by a genome structure at least 90% similar to a genome structure of a bacterial strain selected from the group consisting of:

*Bacillus amyloliquefaciens* A190 strain having an NRRL Accession No. B-67464,

*Bacillus subtilis* P243 strain having an NRRL Accession No. B-67459,

*Bacillus thuringiensis* M979 strain having an NRRL Accession No. B-67457,

*Massilia aurea* P63 strain having an NRRL Accession No. B-67461,

*Rhodococcus* sp. G706 strain,

*Stenotrophomonas maltophilia* E132 strain having an NRRL Accession No. B-67460,

*Streptomyces aurantiacus* A918 strain,

*Streptomyces badius* O180 strain,

*Streptomyces mirabilis* B670 strain having an NRRL Accession No. B67463,

*Streptomyces scopuliridis* F427 strain having an NRRL Accession No. B-67458,

*Streptomyces* sp. E128 strain having an NRRL Accession No. B-67462, and

*Streptomyces* sp. L219 strain.

According to an aspect of some embodiments of the present invention there is provided a biologically pure bacterial isolate characterized by a genome at least 90% identical to a genome of a bacterial strain selected from the group consisting of:

*Bacillus amyloliquefaciens* A190 strain having an NRRL Accession No. B-67464,

*Bacillus subtilis* P243 strain having an NRRL Accession No. B-67459,

*Bacillus thuringiensis* M979 strain having an NRRL Accession No. B-67457,

*Massilia aurea* P63 strain having an NRRL Accession No. B-67461,

*Rhodococcus* sp. G706 strain,

*Stenotrophomonas maltophilia* E132 strain having an NRRL Accession No. B-67460,

*Streptomyces aurantiacus* A918 strain,

*Streptomyces badius* O180 strain,

*Streptomyces mirabilis* B670 strain having an NRRL Accession No. B67463,

*Streptomyces scopuliridis* F427 strain having an NRRL Accession No. B-67458,

*Streptomyces* sp. E128 strain having an NRRL Accession No. B-67462, and

*Streptomyces* sp. L219 strain, or at least 90% identical to a combined coding region existing in genome of a bacterial strain selected from the group consisting of:

*Bacillus amyloliquefaciens* A190 strain having an NRRL Accession No. B-67464,

*Bacillus subtilis* P243 strain having an NRRL Accession No. B-67459,

*Bacillus thuringiensis* M979 strain having an NRRL Accession No. B-67457,

*Massilia aurea* P63 strain having an NRRL Accession No. B-67461,

*Rhodococcus* sp. G706 strain,

*Stenotrophomonas maltophilia* E132 strain having an NRRL Accession No. B-67460,

*Streptomyces aurantiacus* A918 strain,

*Streptomyces badius* O180 strain,

*Streptomyces mirabilis* B670 strain having an NRRL Accession No. B67463,

*Streptomyces scopuliridis* F427 strain having an NRRL Accession No. B-67458,

*Streptomyces* sp. E128 strain having an NRRL Accession No. B-67462, and

*Streptomyces* sp. L219 strain.

According to an aspect of some embodiments of the present invention there is provided a biologically pure bacterial isolate comprising a 16S ribosomal RNA (16S rRNA) nucleic acid sequence at least 97% identical to a polynucleotide sequence selected from the group consisting of SEQ ID NOs: 753-764.

According to an aspect of some embodiments of the invention, there is provided a biologically pure bacterial isolate comprising in a genome thereof a coding sequence of at least one polypeptide selected from the group consisting of:

(i) a polypeptide comprising an amino acid sequence comprising at least one domain characterized by an InterPro accession number selected from the group consisting of: IPR005546 and IPR006315 and exhibiting at least 70%, at least 75%, at least 80%, at least 85%, at least 90%, at least 95% or more sequence identity to the amino acid sequence selected from the group consisting of SEQ ID NOs: 257, 284-285, 377-387 and 457-471, wherein the polypeptide belongs to the same protein family as SEQ ID NOs: 257, 284-285, 377-387 and 457-471 and having an insect killing or inhibitory activity;

(ii) a polypeptide comprising an amino acid sequence comprising a domain characterized by an InterPro accession number IPR027295 and exhibiting at least 81%, at least 82%, at least 85%, at least 90%, at least 95% or more sequence identity to the amino acid sequence selected from the group consisting of SEQ ID NOs: 250, 296, 306-315 and 486-490, wherein the polypeptide belongs to the same protein family as SEQ ID NOs: 250, 296, 306-315 and 486-490 and having an insect killing or inhibitory activity, and (iii) a polypeptide comprising an amino acid sequence comprising at least one domain characterized by an InterPro accession number selected from the group consisting of: IPR011658, IPR003961 and IPR0137833 and exhibiting at least 29%, at least 30%, at least 35%, at least 40%, at least 50%, at least 55%, at least 60%, at least 65%, at least 70%, at least 75%, at least 80%, at least 85%, at least 90%, at least 95% or more sequence identity to the amino acid sequence selected from the group consisting of SEQ ID NOs: 259, 286-295, 393-395, and 472-485, wherein the polypeptide belongs to the same protein family as SEQ ID NOs: 259, 286-295, 393-395, and 472-485 and having an insect killing or inhibitory activity.

According to an aspect of some embodiments of the present invention there is provided a biologically pure bacterial isolate comprising in a genome thereof a coding sequence of polypeptide at least 80% homologous to an amino acid sequence selected from the group consisting of SEQ ID NOs: 249-495, 552-607, and 656-697.

According to an aspect of some embodiments of the present invention there is provided a biologically pure bacterial isolate comprising in a genome thereof a coding sequence of at least one polypeptide selected from the group consisting of:

(i) a polypeptide comprising at least one domain characterized by an InterPro accession number selected from the group consisting of: IPR005546 and IPR006315 and exhibiting at least 70% sequence identity to the amino acid sequence selected from the group consisting of SEQ ID NOs: 257, 284-285, 377-387 and 457-471;

(ii) a polypeptide comprising a domain characterized by an InterPro accession number IPR027295 and exhibiting at least 81% sequence identity to the amino acid sequence selected from the group consisting of SEQ ID NOs: 250, 296, 306-315 and 486-490; and (iii) a polypeptide comprising at least one domain characterized by an InterPro accession number selected from the group consisting of: IPR011658, IPR003961 and IPR0137833 and exhibiting at least 29% sequence identity to the amino acid sequence selected from the group consisting of SEQ ID NOs: 259, 286-295, 393-395, 472-485.

According to an aspect of some embodiments of the present invention there is provided a lysate of any of the biologically pure bacterial isolate of some embodiments of the invention.

According to an aspect of some embodiments of the present invention there is provided a whole cell broth collected from fermentation of the biologically pure bacterial isolate of some embodiments of the invention.

According to an aspect of some embodiments of the present invention there is provided a whole cell broth collected from fermentation of a biologically pure bacterial isolate comprising a bacterial strain selected from the group consisting of:

*Bacillus amyloliquefaciens* A190 strain having an NRRL Accession No. B-67464,

*Bacillus subtilis* P243 strain having an NRRL Accession No. B-67459,

*Bacillus thuringiensis* M979 strain having an NRRL Accession No. B-67457,

*Massilia aurea* P63 strain having an NRRL Accession No. B-67461,

*Rhodococcus* sp. G706 strain,

*Stenotrophomonas maltophilia* E132 strain having an NRRL Accession No. B-67460,

*Streptomyces aurantiacus* A918 strain,

*Streptomyces badius* O180 strain,

*Streptomyces mirabilis* B670 strain having an NRRL Accession No. B67463,

*Streptomyces scopuliridis* F427 strain having an NRRL Accession No. B-67458,

*Streptomyces* sp. E128 strain having an NRRL Accession No. B-67462, and

*Streptomyces* sp. L219.

According to an aspect of some embodiments of the present invention there is provided a biologically pure modified bacterial isolate having an improved insect killing or inhibitory activity as compared to a biologically pure bacterial isolate of the same species according to some embodiments of the invention, wherein the modified bacterial isolate is a non-genetically modified organism (Non-GMO).

According to an aspect of some embodiments of the present invention there is provided a biologically pure modified bacterial isolate having an improved insect killing or inhibitory activity as compared to a biologically pure bacterial isolate of the same species according to some embodiments of the invention, wherein the biologically pure modified bacterial isolate over-expresses a polypeptide comprising an amino acid sequence at least 80% homologous to the amino acid sequence selected from the group consisting of SEQ ID NOs: 249-495, 552-607, and 656-697.

According to an aspect of some embodiments of the present invention there is provided a method of obtaining a modified bacterial isolate having an improved insect killing or inhibitory activity as compared to a biologically pure bacterial isolate of the same species according to some embodiments of the invention, comprising:

(a) culturing the bacterial isolate according to some embodiments of the invention under conditions suitable for expanding a population of the bacterial isolate and allowing evolvement of at least one bacterial mutant, and (b) selecting the at least one bacterial mutant resultant of step (a) for an improved insect killing or inhibitory activity, thereby obtaining the modified bacterial isolate having the improved insect killing or inhibitory activity as compared to the biologically pure bacterial isolate of the same species according to some embodiments of the invention.

According to an aspect of some embodiments of the present invention there is provided a lysate prepared from the biologically pure modified bacterial isolate of some embodiments of the invention, or from the modified bacterial isolate resultant of the method of some embodiments of the invention.

According to an aspect of some embodiments of the present invention there is provided an isolated polypeptide comprising an amino acid sequence at least 80% homologous to an amino acid sequence selected from the group consisting of SEQ ID NOs: 249-495, 552-607, 632-655 and 656-697.

According to an aspect of some embodiments of the present invention there is provided an isolated polypeptide selected from the group consisting of:

(i) a polypeptide comprising at least one domain characterized by an InterPro accession number selected from the group consisting of: IPR005546 and IPR006315 and exhibiting at least 70% sequence identity to the amino acid sequence selected from the group consisting of SEQ ID NOs: 257, 284-285, 377-387 and 457-471;

(ii) a polypeptide comprising a domain characterized by an InterPro accession number IPR027295 and exhibiting at least 81% sequence identity to the amino acid sequence selected from the group consisting of SEQ ID NOs: 250, 296, 306-315 and 486-490; and (iii) a polypeptide comprising at least one domain characterized by an InterPro accession number selected from the group consisting of: IPR011658, IPR003961 and IPR0137833 and exhibiting at least 29% sequence identity to the amino acid sequence selected from the group consisting of SEQ ID NOs: 259, 286-295, 393-395, and 472-485.

According to an aspect of some embodiments of the present invention there is provided an isolated polynucleotide comprising a nucleic acid sequence encoding a polypeptide having an amino acid sequence at least 80% homologous to an amino acid sequence selected from the group consisting of SEQ ID NOs: 249-495, 552-607, 632-655 and 656-697.

According to an aspect of some embodiments of the present invention there is provided an isolated polynucleotide comprising a nucleic acid sequence encoding the polypeptide of some embodiments of the invention.

According to an aspect of some embodiments of the present invention there is provided a nucleic acid construct comprising the isolated polynucleotide of some embodiments of the invention, and a promoter operably linked thereto, wherein the promoter is capable of directing transcription of the nucleic acid sequence in a host cell.

According to an aspect of some embodiments of the present invention there is provided a plant cell transformed with a nucleic acid construct comprising an isolated polynucleotide encoding a polypeptide comprising an amino acid sequence selected from the group consisting of SEQ ID NOs: 249-495, 632-655 and 656-697 and a promoter operably linked thereto, wherein the promoter is capable of directing transcription of the nucleic acid sequence in the plant cell.

According to an aspect of some embodiments of the present invention there is provided a plant cell transformed with a nucleic acid construct comprising the isolated polynucleotide of some embodiments of the invention, and a promoter operably linked thereto, wherein the promoter is capable of directing transcription of the nucleic acid sequence in the plant cell.

According to an aspect of some embodiments of the present invention there is provided a plant cell expressing a polypeptide comprising an amino acid sequence at least 80% homologous to the amino acid sequence selected from the group consisting of SEQ ID NOs: 249-495, 632-655 and 656-697.

According to an aspect of some embodiments of the present invention there is provided a plant comprising the plant cell of some embodiments of the invention.

According to an aspect of some embodiments of the present invention there is provided a composition-of-matter comprising the biologically pure bacterial isolate of some embodiments of the invention, the biologically pure modified bacterial isolate of some embodiments of the invention, or the modified bacterial isolate resultant of the method of some embodiments of the invention.

According to an aspect of some embodiments of the present invention there is provided a composition-of-matter comprising the lysate of some embodiments of the invention, or the whole cell broth of some embodiments of the invention.

According to an aspect of some embodiments of the present invention there is provided a composition-of-matter comprising the isolated polypeptide of some embodiments of the invention.

According to an aspect of some embodiments of the present invention there is provided a composition-of-matter comprising a combination of at least two distinct biologically pure bacterial isolates according to some embodiments of the invention, and/or at least two distinct lysates according to some embodiments of the invention, and/or at least two distinct bacterial broths according to some embodiments of the invention.

According to an aspect of some embodiments of the present invention there is provided a composition-of-matter comprising at least two distinct isolated polypeptides according to some embodiments of the invention, at least two distinct isolated polynucleotides according to some embodiments of the invention, and/or at least two distinct nucleic acid constructs according to some embodiments of the invention.

According to an aspect of some embodiments of the present invention there is provided a composition-of-matter comprising:

(a) a whole cell broth collected from fermentation of the biologically pure bacterial isolate of some embodiments of the invention, the biologically pure modified bacterial isolate of some embodiments of the invention, or the modified bacterial isolate resultant of the method of some embodiments of the invention, wherein the fermentation has an insect killing or inhibitory activity; and (b) at least one of a carrier, a stabilizer, a diluent, a surfactant, a mineral or an adjuvant.

According to an aspect of some embodiments of the present invention there is provided a container adapted for a watering system of a plant field comprising the composition-of-matter of some embodiments of the invention.

According to an aspect of some embodiments of the present invention there is provided a kit comprising the composition-of-matter of some embodiments of the invention or the container of some embodiments of the invention, and instructions for use in killing or inhibiting the development of an insect.

According to an aspect of some embodiments of the present invention there is provided a coated seed comprising a plant seed and a coating on the plant seed, wherein the coating comprises the composition-of-matter of some embodiments of the invention.

According to an aspect of some embodiments of the present invention there is provided a method of increasing a resistance of a plant to an insect, comprising expressing within the plant a polypeptide comprising an amino acid sequence at least 80% homologous to an amino acid sequence selected from the group consisting of SEQ ID NOs: 249-495, 632-655 and 656-697, thereby increasing the resistance of the plant to the insect.

According to an aspect of some embodiments of the present invention there is provided a method of increasing a resistance of a plant to an insect, comprising expressing within the plant the isolated polypeptide of some embodiments of the invention, thereby increasing the resistance of the plant to the insect.

According to an aspect of some embodiments of the present invention there is provided a method of inhibiting an insect in a plant, comprising contacting the plant or a part thereof with the biologically pure bacterial isolate of some embodiments of the invention, the biologically pure modified bacterial isolate of some embodiments of the invention, the modified bacterial isolate resultant of the method of some embodiments of the invention, the lysate of some embodiments of the invention, the whole cell broth of some embodiments of the invention, the isolated polypeptide of some embodiments of the invention, and/or the composition-of-matter of some embodiments of the invention, thereby inhibiting the insect.

According to an aspect of some embodiments of the present invention there is provided a kit comprising a bacterial DNA, at least one DNA sequencing agent, and a software for determination of coding region(s) in the bacterial DNA, wherein the bacterial DNA is obtained from the biologically pure bacterial isolate of some embodiments of the invention, the biologically pure modified bacterial isolate of some embodiments of the invention, the modified bacterial isolate resultant of the method of some embodiments of the invention, the lysate of some embodiments of the invention, the whole cell broth of some embodiments of the invention, or the composition-of-matter of some embodiments of the invention.

According to some embodiments of the invention the functionally homologous strain has at least 99.5% sequence identity to a genome of the biologically pure bacterial isolate strain or at least 99.5% sequence identity to a 16S rRNA of the biologically pure bacterial isolate strain.

According to some embodiments of the invention the polypeptide in (iii) comprises the domains characterized by InterPro accession numbers IPR011658, IPR003961 and IPR0137833.

Figure 1B:
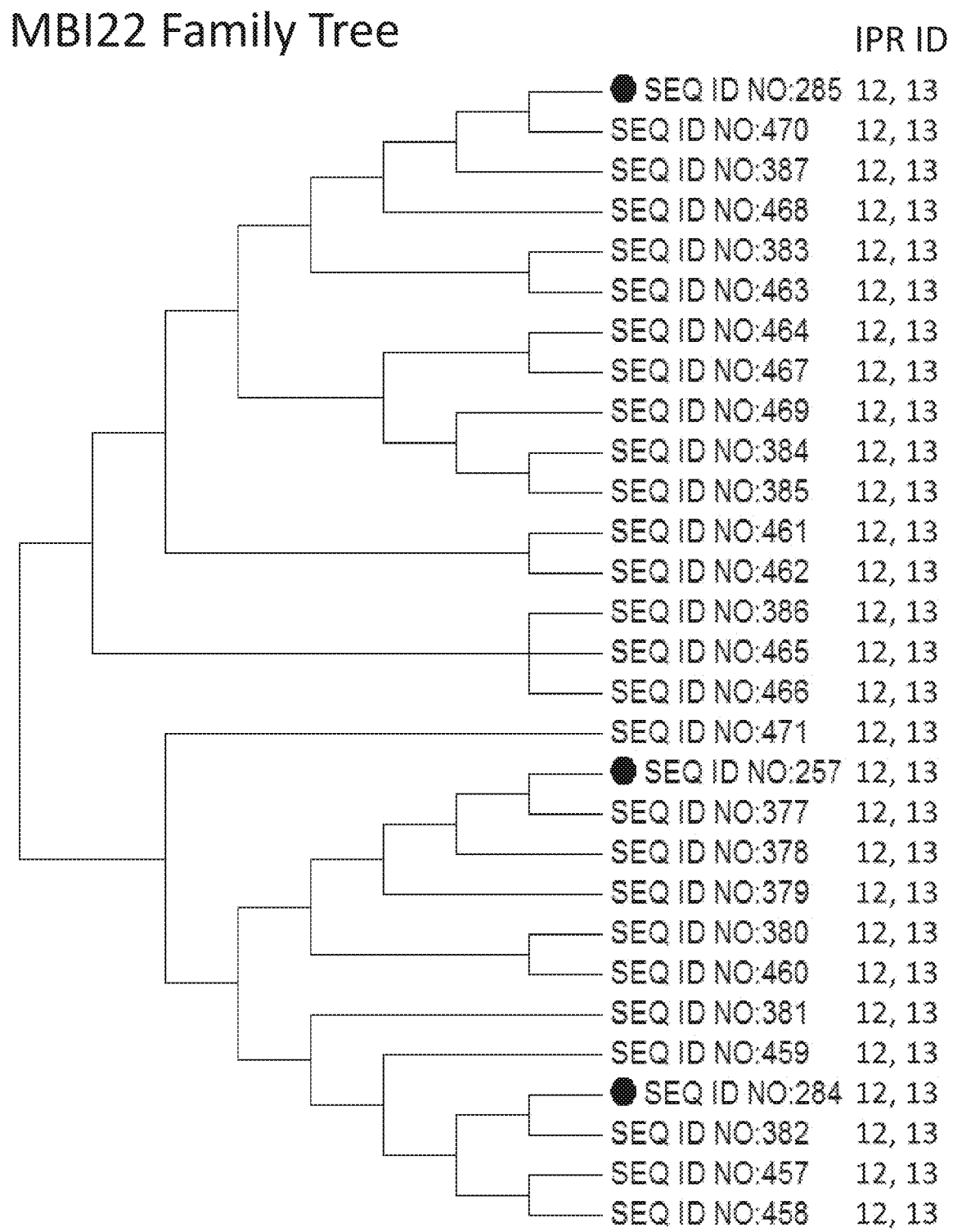
Figure 1C:
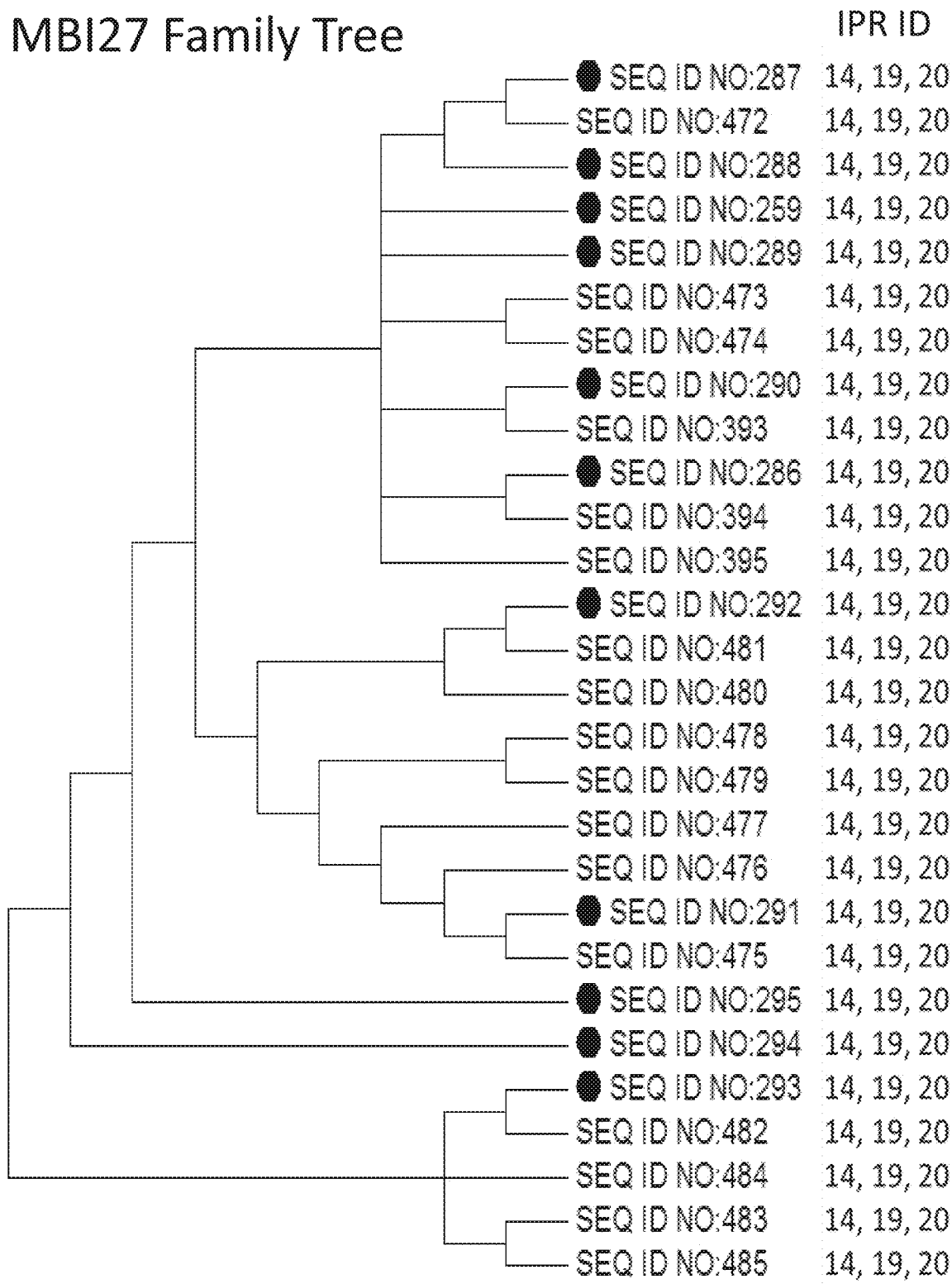

According to some embodiments of the invention the polypeptide is embedded in a phylogenetic tree selected from the group consisting of the phylogenetic trees depicted in FIG. 1A, FIG. 1B and FIG. 1C.

According to some embodiments of the invention the phylogenetic tree is constructed by the MEGA7 software and the neighbor joining method using default parameters.

According to some embodiments of the invention wherein the polypeptide in (i) is selected from the group consisting of SEQ ID NOs: 257, 284-285, 377-387 and 457-471, wherein the polypeptide in (ii) is selected from the group consisting of SEQ ID NOs: 250, 296, 306-315 and 486-490, and wherein the polypeptide in (iii) is selected from the group consisting of SEQ ID NOs: 259, 286-295, 393-395, and 472-485.

According to some embodiments of the invention wherein cells of the bacterial isolate are dead bacterial cells.

According to some embodiments of the invention the bacteria is lysed.

According to some embodiments of the invention the biologically pure bacterial isolate, the lysate or the whole cell broth is capable of killing or inhibiting the development of an insect.

According to some embodiments of the invention the functionally homologous strain has substantially the same coding and/or non-coding sequence orientation as that of the bacterial isolate strain homologous thereto.

According to some embodiments of the invention, wherein over-expression of the polypeptide in the bacterial isolate is obtainable by a technique selected from the group consisting of genome editing, transformation and transfection.

According to some embodiments of the invention the conditions comprise mutation inducing conditions.

According to some embodiments of the invention the selecting in step (b) is for a bacterial mutant having a mutation in a polynucleotide encoding a polypeptide comprising an amino acid sequence at least 80% homologous to the amino acid sequence selected from the group consisting of: SEQ ID NOs: 249-495, 552-607, and 656-697.

According to some embodiments of the invention the mutation results in increased activity of the polypeptide as compared to the activity level of the polypeptide in the biologically pure bacterial isolate of the same species according to some embodiments of the invention.

According to some embodiments of the invention the method further comprising qualifying the modified bacterial isolate for an improved insect killing or inhibitory activity as compared to the biologically pure bacterial isolate of the same species according to some embodiments of the invention.

According to some embodiments of the invention the lysate comprising a whole cell lysate of a bacterial preparation.

According to some embodiments of the invention the lysate comprising a soluble fraction of a bacterial preparation.

According to some embodiments of the invention the lysate comprising inclusion bodies of a bacterial preparation.

According to some embodiments of the invention the polypeptide in (iii) comprises the domains characterized by InterPro accession numbers IPR011658, IPR003961 and IPR0137833.

According to some embodiments of the invention the isolated polypeptide is embedded in a phylogenetic tree selected from the group consisting of the phylogenetic trees depicted in FIG. 1A, FIG. 1B and FIG. 1C.

According to some embodiments of the invention wherein the polypeptide in (i) is selected from the group consisting of SEQ ID NOs: 285, 470, 387, 468, 383, 463, 464, 467, 469, 384, 385, 461,462, 386, 465, 466, 471, 257, 377, 378, 379, 380, 460, 381, 459, 284, 382, 457, and 458, the polypeptide in (ii) is selected from the group consisting of SEQ ID NOs: 308, 310, 307, 489, 488, 490, 250, 306, 309, 311, 487, 313, 296, 486, 312, 314 and 315, and wherein the polypeptide in (iii) is selected from the group consisting of SEQ ID NOs: 259, 286-295, 393-395, and 472-485.

According to some embodiments of the invention the nucleic acid sequence is selected from the group consisting of SEQ ID NOs: 1-248, 496-551, and 608-631.

According to some embodiments of the invention the promoter is heterologous to the isolated polynucleotide and/or to the host cell.

According to some embodiments of the invention the polypeptide is capable of killing or inhibiting the development of an insect.

According to some embodiments of the invention the composition-of-matter comprising the isolated polynucleotide of some embodiments of the invention, or the nucleic acid construct of some embodiments of the invention.

According to some embodiments of the invention the composition-of-matter further comprising at least one agent selected from the group consisting of: a carrier, a stabilizer, a diluent, a surfactant, a mineral and an adjuvant.

According to some embodiments of the invention the composition-of-matter is in a dehydrated form.

According to some embodiments of the invention the composition-of-matter is in lyophilized form.

According to some embodiments of the invention the composition-of-matter is comprised in a container or in a packaging material.

According to some embodiments of the invention the composition-of-matter being in a pressurized form, a pressurizable form, a dry form, a liquid form, and/or a sprayable form.

According to some embodiments of the invention the coating further comprising at least one agent selected from the group consisting of: a wetting agent, a binding agent, an agricultural active agent, and a nutrient.

According to some embodiments of the invention the expressing the polypeptide is performed by transforming a plant cell with a polynucleotide comprising a nucleic acid sequence selected from the group consisting of SEQ ID NOs: 1-248, and 608-631.

According to some embodiments of the invention the polypeptide is capable of killing or inhibiting the development of the insect.

According to some embodiments of the invention the insect is of an insect order selected from the group consisting of Lepidoptera, Coleoptera, Hemiptera, and Acari.

According to some embodiments of the invention the insect is selected from the group consisting of Beet Armyworm (BAW) (*Spodoptera exigua*), Lygus (*Lygus hesperus*), Cabbage Loopers (*Trichoplusia ni*, Diamondback Moth (*Plutella xylostella*), Fall armyworm (*Spodoptera frugiperda*), Western corn rootworm (*Diabrotica virgifera virgifera*), Green Peach Aphids (*Myzus persicae*), and Soybean Looper (*Chrysodeixis includens*) and Twospotted spider mite (*Tetranychus urticae*).

According to some embodiments of the invention the insect is Beet Armyworm (*Spodoptera exigua*) then the plant is from a plant family selected from the group consisting of: Poaceae, Malvaceae, Liliaceae, Amaranthaceae, Fabaceae, Solanaceae, Chenopodiaceae, Brassicaceae, Solanaceae, Cyperaceae, Juglandaceae, Asteraceae, Cucurbitaceae, Rutaceae, Euphorbiaceae, Convolvulaceae, Caryophyllaceae, Apiaceae, Polygonaceae, Rosaceae, Iridaceae, Musaceae, Geraniaceae, Platanaceae, Apocynaceae, Portulacaceae, Rosaceae, Ericaceae, Violaceae, Vitaceae, and Zingiberaceae.

According to some embodiments of the invention the insect is Cabbage Looper (*Trichoplusia ni*) then the plant is from a plant family selected from the group consisting of: crucifers, beet, cantaloupe, celery, cucumber, lima bean, lettuce, parsnip, pea, pepper, potato, snap bean, spinach, squash, sweet potato, tomato, watermelon, chrysanthemum, hollyhock, snapdragon, sweetpea, cotton, tobacco, *Chenopodium album, Lactuca* spp. (wild lettuce), *Taraxacum officinale* (dandelion), and *Rumex crispus* (curly dock).

According to some embodiments of the invention the insect is Diamondback Moth (*Plutella xylostella*) then the plant is from a plant family selected from the group consisting of: Malvaceae, Brassicaceae, Capparaceae, Asteraceae and Fabaceae.

According to some embodiments of the invention the insect is Green Peach Aphid (*Myzus persicae*) then the plant is from a plant family selected from the group consisting of: Malvaceae, Euphorbiaceae, Aloaceae, Boraginaceae, Apiaceae, Scrophulariaceae, Araceae, Fabaceae, Brassicaceae, Asteraceae, Liliaceae, Chenopodiaceae, Solanaceae, Caricaceae, Apocynaceae, Cucurbitaceae, Rutaceae, Convolvulaceae, Iridaceae, Rosaceae, Caryophyllaceae, Euphorbiaceae, Iridaceae, Malvaceae, Poaceae, Cannabaceae, Balsaminaceae, Convolvulaceae, Poaceae, Lamiaceae, Papaveraceae, Lauraceae, Myrtaceae, Punicaceae, Anacardiaceae, Polygonaceae, and Pedaliaceae.

According to some embodiments of the invention the insect is Soybean Looper (*Chrysodeixis includens*) then the plant is from a plant family selected from the group consisting of: Amaranthaceae, Apiaceae, Araceae, Araliaceae, Asteraceae, Begoniaceae, Brassicaceae, Caryophyllaceae, Chenopodiaceae, Convolvulaceae, Cucurbitaceae, Euphorbiaceae, Fabaceae, Geraniaceae, Gesneriaceae, Hydrangeaceae, Lamiaceae, Lauraceae, Liliaceae, Malvaceae, Passifloraceae, Piperaceae, Poaceae, Polygonaceae, Portulacaceae, Rubiaceae, and Solanaceae.

According to some embodiments of the invention the insect is Fall armyworm (*Spodoptera frugiperda*) then the plant is from a plant family selected from the group consisting of: Amaranthaceae, Apiaceae, Apocynaceae, Asteraceae, Brassicaceae, Caryophyllaceae, Chenopodiaceae, Convolvulaceae, Cucurbitaceae, Cyperaceae, Euphorbiaceae, Fabaceae, Geraniaceae, Iridaceae, Juglandaceae, Liliaceae, Malvaceae, Musaceae, Platanaceae, Poaceae, Poaceae, Polygonaceae, Portulacaceae, Rosaceae, Rutaceae, Solanaceae, Ericaceae, Violaceae, Vitaceae, and Zingiberaceae.

According to some embodiments of the invention the insect is Western corn rootworm (*Diabrotica virgifera virgifera*) then the plant is from a plant family selected from the group consisting of: Asteraceae, Cucurbitaceae, Fabaceae, and Poaceae.

According to some embodiments of the invention the insect is Lygus (*Lygus hesperus*) then the plant is from a plant family selected from the group consisting of: Cruciferae, Fabaceae, Malvaceae, Rosaceae, and Umbelliferae.

According to some embodiments of the invention wherein when the insect is Acari then the plant is from a family of selected from the group consisting of Malvaceae, Asteraceae, Actinidiaceae, Liliaceae, Fabaceae, Apiaceae, Oxalidaceae, Chenopodiaceae, Theaceae, Solanaceae, Caricaceae, Apocynaceae, Cucurbitaceae, Rutaceae, Convolvulaceae, Betulaceae, Orchidaceae, Caryophyllaceae, Ebenaceae, Zingiberaceae, Salacia. Euphorbiaceae, Moraceae, Rosaceae, Iridaceae, Araliaceae, Cannabaceae, quifoliaceae, Balsaminaceae, Lamiaceae, Poaceae, Papaveraceae, Geraniaceae, Arecaceae, Ericaceae, Grossulariaceae, Pedaliaceae, Combretaceae, Tiliaceae, Violaceae, and Vitaceae.

According to some embodiments of the invention wherein when the insect is Twospotted spider mite then the plant is from a family selected from the group consisting of Malvaceae, Asteraceae, Actinidiaceae, Liliaceae, Fabaceae, Apiaceae, Oxalidaceae, Chenopodiaceae, Theaceae, Solanaceae, Caricaceae, Apocynaceae, Cucurbitaceae, Rutaceae, Convolvulaceae, Betulaceae, Orchidaceae, Caryophyllaceae, Ebenaceae, Zingiberaceae, Salacia, Euphorbiaceae, Moraceae, Rosaceae, Iridaceae, Araliaceae, Cannabaceae, quifoliaceae, Balsaminaceae, Lamiaceae, Poaceae, Papaveraceae, Geraniaceae, Arecaceae, Ericaceae, Grossulariaceae, Pedaliaceae, Combretaceae, Tiliaceae, Violaceae, and Vitaceae.

According to some embodiments of the invention the biologically pure bacterial isolate is in a sporulated form.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWING(S)

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 1A-C—Phylogenetics trees for the MBI4, MBI22 and MBI27 gene families. Phylogenetic trees of MBI4, MBI22 and MBI27 families (FIG. 1A, FIG. 1B, and FIG. 1C, respectively) were constructed based on protein sequence alignment generated by MAFFT version 7 (Katoh, Kazutaka, and Daron M. Standley. "MAFFT Multiple Sequence Alignment Software Version 7: Improvements in Performance and Usability." *Molecular Biology and Evolution* 30.4 (2013): 772-780. PMC. Web. 19 Jul. 2018), utilizing MEGA7 software (Kumar, S., Stecher, G., & Tamura, K. (2016). MEGA7: Molecular Evolutionary Genetics Analysis version 7.0 for bigger datasets. Mol. Biol. Evol. 33(7):1870-1874) and neighbor joining method (Saitou N, Nei M. "The neighbor-joining method: a new method for reconstructing phylogenetic trees." *Molecular Biology and Evolution*, volume 4, issue 4, pp. 406-425, July 1987). Leaves are denoted as SEQ ID NOs of the polypeptide. The SEQ ID NOs. having a validated insecticidal activity (as described herein) are marked with black dots. Domain composition is provided by indicating IPR IDs (in conjunction with Tables 29 and 30) identified in each of the polypeptide SEQ ID NOs. as described in Examples 4 and 6 of the Examples section which follows.

Figure 2:
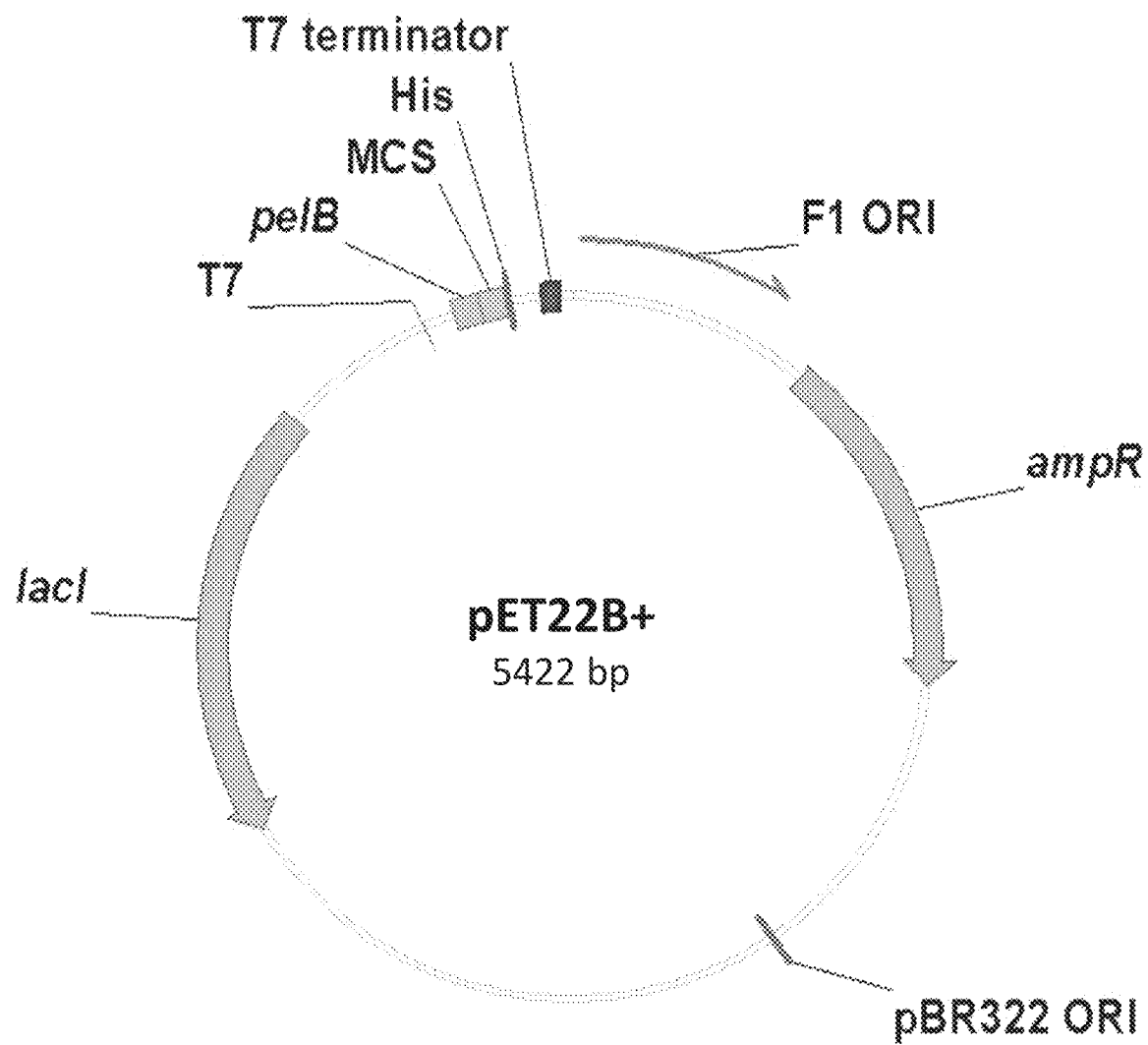

FIG. 2 is a schematic illustration of a nucleic acid construct according to some embodiments of the invention. Shown is the pET22b+ plasmid used for expressing the isolated polynucleotide sequence of some embodiments of the invention. T7=T7 promoter; pBR322 ORI=Origin of replication; His=His Tag coding sequence; peIB=N terminal peIB signal coding sequence; lacI=lacI repressor gene; ampR=ampicillin resistance gene. The isolated polynucleotide sequences according to some embodiments of the invention were cloned into the MCS (Multiple cloning site) of the vector.

Figure 3:
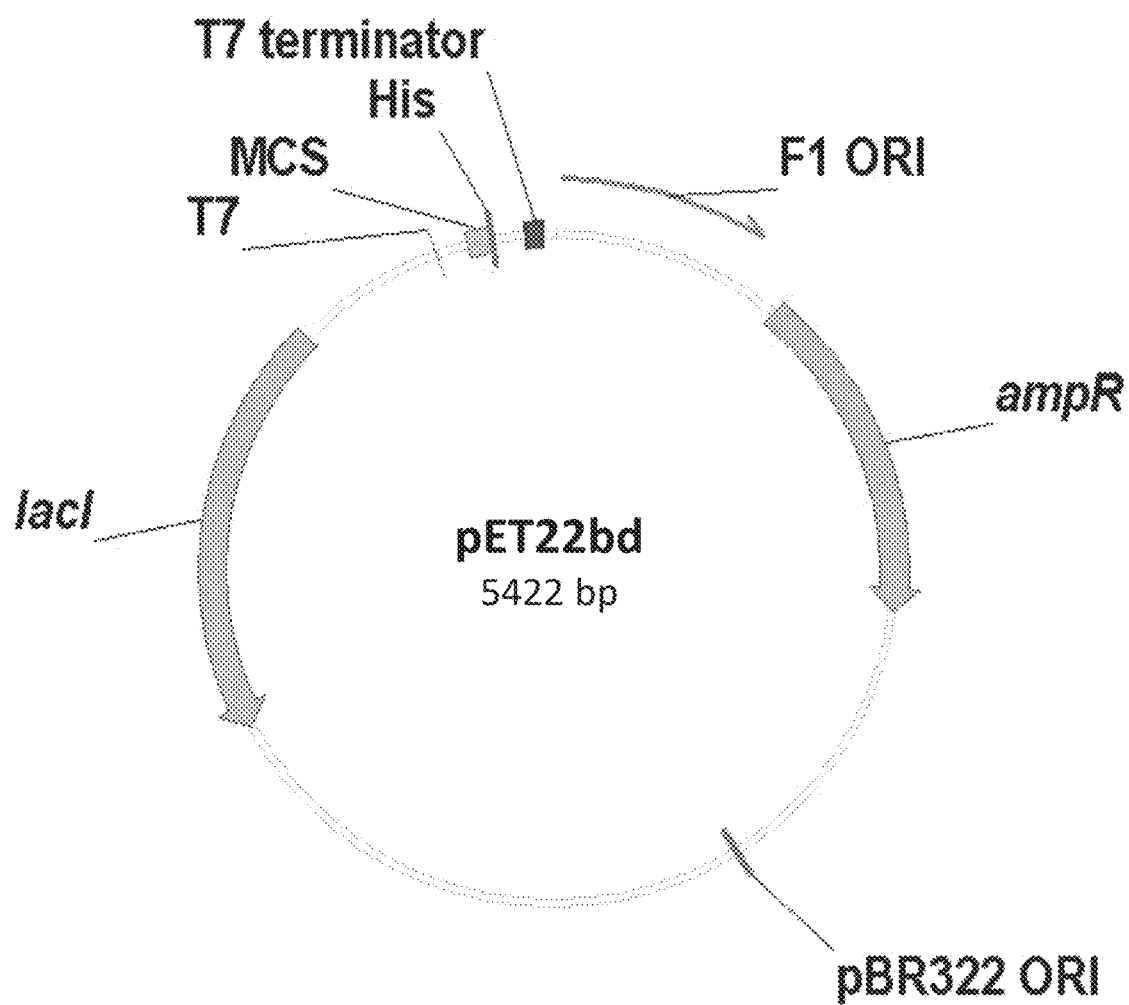

FIG. 3 is a schematic illustration of a nucleic acid construct according to some embodiments of the invention. Shown is the pET22bd plasmid used for expressing the isolated polynucleotide sequence of some embodiments of the invention. T7=T7 promoter; pBR322 ORI=Origin of replication; His=His Tag coding sequence; ampR=ampicillin resistance gene; lacI=lacI repressor gene. The isolated polynucleotide sequences according to some embodiments of the invention were cloned into the MCS (Multiple cloning site) of the vector.

Figure 4:
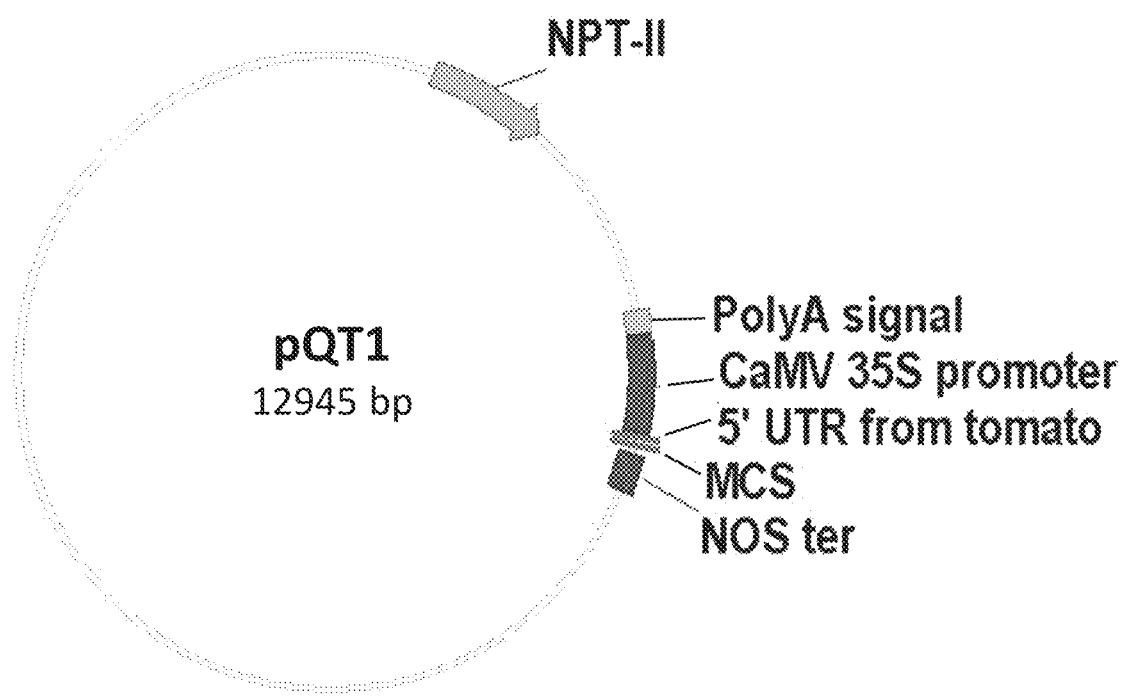

FIG. 4 is a schematic illustration of a nucleic acid construct according to some embodiments of the invention. Shown is the modified pQT1 binary plasmid containing the CaMV 35S promoter used for expressing the isolated polynucleotide sequence of some embodiments of the invention. NPT-II=neomycin phosphotransferase gene; NOS ter=nopaline synthase terminator; PolyA signal=polyadenylation signal; 5' UTR from tomato. The isolated polynucleotide sequences according to some embodiments of the invention were cloned into the MCS (Multiple cloning site) of the vector.

Figure 5:
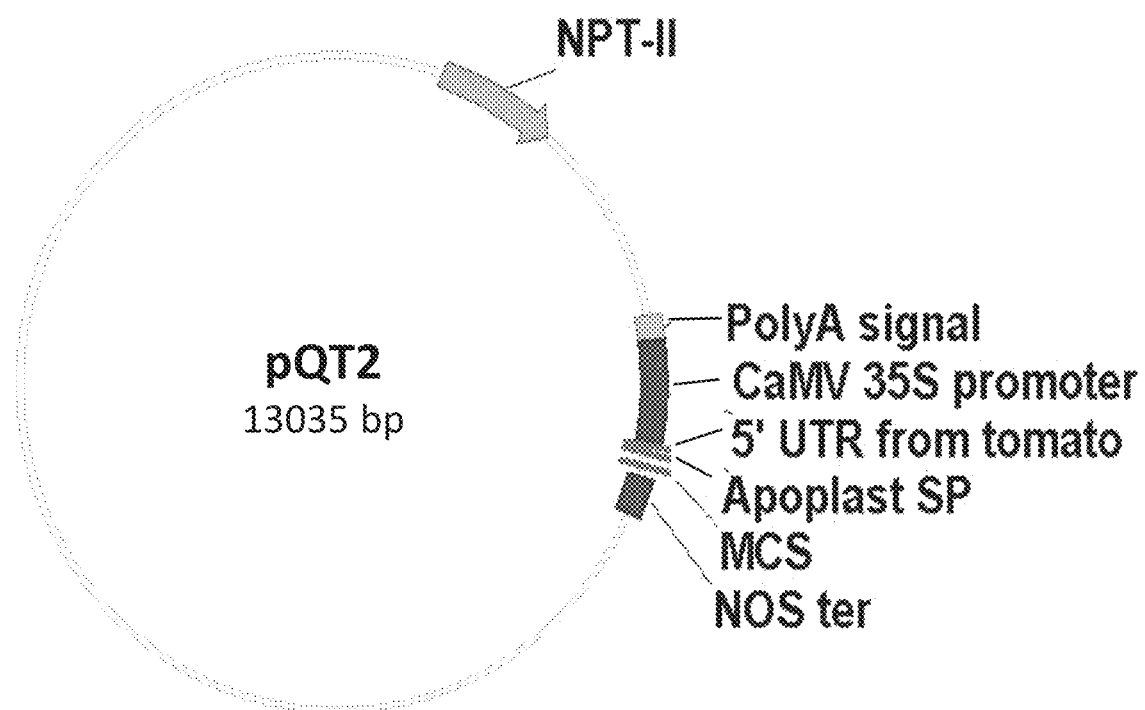

FIG. 5 is a schematic illustration of a nucleic acid construct according to some embodiments of the invention. Shown is the modified pQT2 binary plasmid containing the CaMV 35S promoter used for expressing the isolated polynucleotide sequence of the invention. NPT-II=neomycin phosphotransferase gene; NOS ter=nopaline synthase terminator; PolyA signal=polyadenylation signal; 5' UTR from tomato; Apoplast SP=Apoplast signal peptide. The isolated polynucleotide sequences according to some embodiments of the invention were cloned into the MCS (Multiple cloning site) of the vector.

Figure 6:
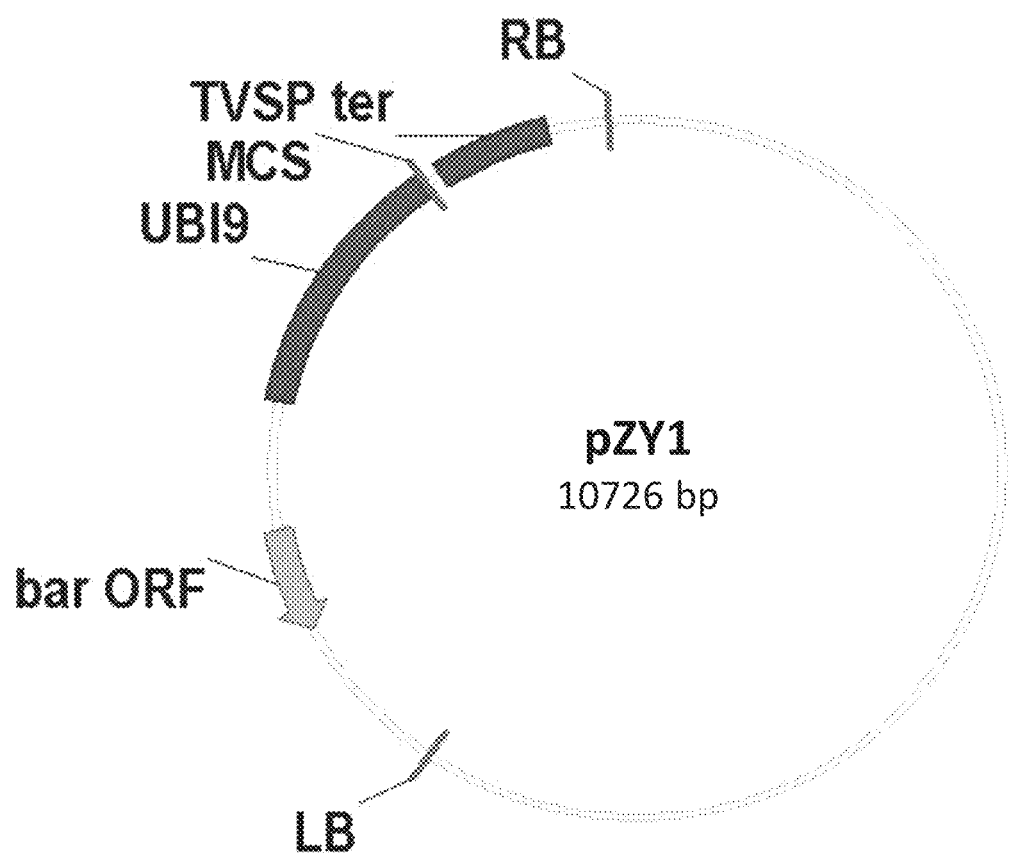

FIG. 6 is a schematic illustration of a nucleic acid construct according to some embodiments of the invention. Shown is the modified pZYI binary plasmid containing the Ubiquitin9 (UBI9) promoter used for expressing the isolated polynucleotide sequence of the invention. RB=T-DNA right border; LB=T-DNA left border; bar ORF=Phosphinothricin N-acetyltransferase gene; TVSP ter=TVSP terminator. The isolated polynucleotide sequences according to some embodiments of the invention were cloned into the MCS (Multiple cloning site) of the vector.

Figure 7:
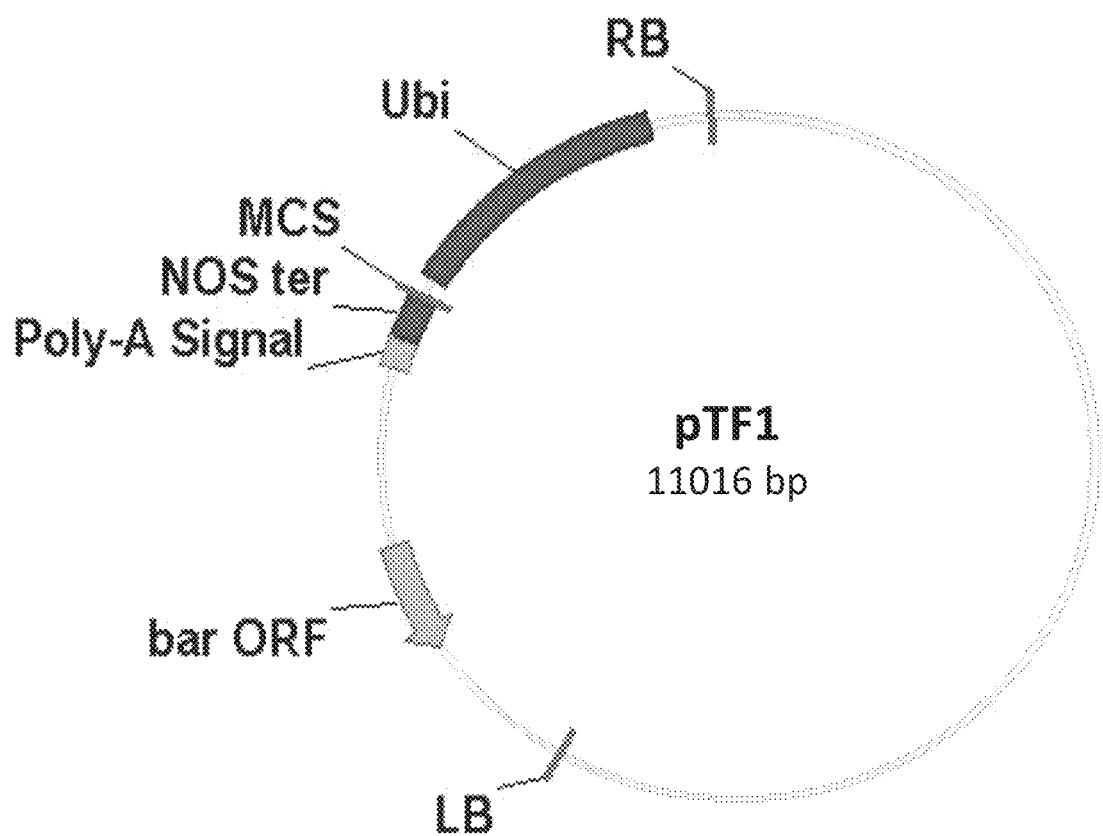

FIG. 7 is a schematic illustration of a nucleic acid construct according to some embodiments of the invention. Shown is the modified pTF1 binary plasmid containing the Maize Ubiquitin promoter (Ubi) used for expressing the isolated polynucleotide sequences of the invention. RB—T-DNA right border; LB—T-DNA left border; bar ORF=Phosphinothricin N-acetyltransferase gene; NOS ter=nopaline synthase terminator, Poly-A signal (polyadenylation signal). The isolated polynucleotide sequences according to some embodiments of the invention were cloned into the MCS (Multiple cloning site) of the vector.

Figure 8:
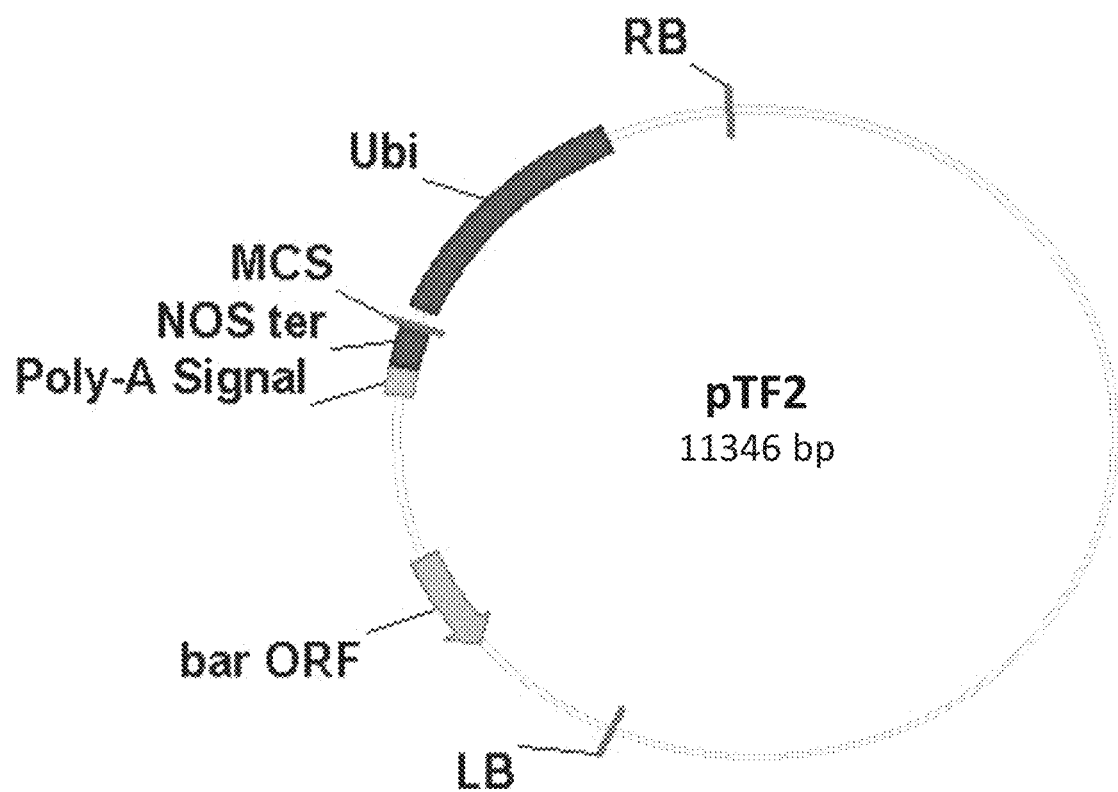

FIG. 8 is a schematic illustration of a nucleic acid construct according to some embodiments of the invention. Shown is the modified pTF2 binary plasmid containing the Maize Ubiquitin promoter (Ubi) used for expressing the isolated polynucleotide sequences of the invention. pTF2 contains additional restriction sites to allow cloning of a 2nd expression cassette (with the same promoter and terminator) into the vector. RB=T-DNA right border; LB=T-DNA left border; bar ORF=Phosphinothricin N-acetyltransferase gene; NOS ter=nopaline synthase terminator; Poly-A signal (polyadenylation signal). The isolated polynucleotide sequences according to some embodiments of the invention were cloned into the MCS (Multiple cloning site) of the vector.

DESCRIPTION OF SPECIFIC EMBODIMENTS OF THE INVENTION

The present invention, in some embodiments thereof, relates to biologically pure bacterial isolate, whole cell broth or lysates thereof, and polynucleotide, polypeptides and constructs expressing same, compositions comprising same and methods using same for killing or inhibiting the development of insects.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

According to an aspect of some embodiments of the invention there is provided a biologically pure bacterial isolate or whole cell broth thereof, comprising a bacterial strain selected from the group consisting of:

*Bacillus amyloliquefaciens* A190 strain having an NRRL Accession No. B-67464 or a functionally homologous strain,

*Bacillus subtilis* P243 strain having an NRRL Accession No. B-67459 or a functionally homologous strain,

*Bacillus thuringiensis* M979 strain having an NRRL Accession No. B-67457 or a functionally homologous strain,

*Massilia aurea* P63 strain having an NRRL Accession No. B-67461 or a functionally homologous strain,

*Rhodococcus* sp. G706 strain or a functionally homologous strain,

*Stenotrophomonas maltophilia* E132 strain having an NRRL Accession No. B-67460 or a functionally homologous strain,

*Streptomyces aurantiacus* A918 strain or a functionally homologous strain,

*Streptomyces badius* O180 strain or a functionally homologous strain,

*Streptomyces mirabilis* B670 strain having an NRRL Accession No. B67463 or a functionally homologous strain,

*Streptomyces scopuliridis* F427 strain having an NRRL Accession No. B-67458 or a functionally homologous strain,

*Streptomyces* sp. E128 strain having an NRRL Accession No. B-67462 or a functionally homologous strain, and

*Streptomyces* sp. L219 strain or a functionally homologous strain.

As used herein the phrase "biologically pure bacterial isolate" refers to a bacterium which has been separated from an environment or from one or more constituents thereof, cellular or otherwise, which may be associated with if found in nature.

As defined herein, "whole broth culture" or "whole cell broth", which are interchangeably used herein, refers to a liquid culture containing both cells and a liquid medium.

It should be noted that a whole cell broth can be obtained by growing bacterial cells in a liquid medium, or by suspending (also referred to as harvesting) bacterial cells grown on an agar plate in a liquid medium.

As defined herein, "supernatant" refers to the liquid remaining when cells grown in broth, or harvested in another liquid from an agar plate, are removed by centrifugation, filtration, sedimentation, or other means well known in the art.

As defined herein, "filtrate" refers to liquid from a whole broth culture that has passed through a membrane.

As defined herein, "extract" refers to a liquid substance removed from cells by a solvent (water, detergent, buffer, organic solvent) and separated from the cells by centrifugation, filtration or other method.

According to some embodiments of the invention, the bacterial isolate is of a Gram-positive bacterium.

According to some embodiments of the invention, the bacterial isolate is of a Gram-negative bacterium.

According to some embodiments of the invention, the bacterial isolate is in a sporulated form.

The bacterial strain can be as deposited or a variant thereof, also referred to herein as a "functional homolog".

The term "bacterial strain" can refer to the strain included in the biologically purified bacterial isolate, e.g., the deposited strain in a depository (e.g., NRRL) and/or to a functional homolog thereof.

A "functional homolog" or a "functionally homologous" or a "variant" or grammatical equivalents as used herein refers to a modification (i.e., at least one mutation) of the deposited bacterial strain resulting in a bacterial strain that is endowed with substantially the same ensemble of biological activities (+/−10%, 20%, 40%, 50%, 60% when tested under the same conditions) as that of the deposited strain and can be classified to the same species or strain based on known methods of species/strain classifications.

Following are non-limiting criteria for identifying a functional homolog. These criteria, which are mostly genetic, combined with the functional characteristic as defined in Tables 33-41 will be apparent to the skilled artisan to define the scope of the functional homolog.

According to a specific embodiment, the deposited strain and the functional homolog belong to the same operational taxonomic units (OTU).

An "OTU" (or plural, "OTUs") refers to a terminal leaf in a phylogenetic tree and is defined by a nucleic acid sequence, e.g., the entire genome, or a specific genetic sequence, and all sequences that share sequence identity to this nucleic acid sequence at the level of species. In some embodiments the specific genetic sequence may be the 16S-rRNA (ribosomal RNA) sequence or a portion of the 16S-rRNA (also referred to herein as "16S") sequence or other functionally conserved genes as listed below. In other embodiments, the entire genomes of two entities are sequenced and compared. In another embodiment, selected regions such as multilocus sequence tags (MLST, MLSA), specific genes, or sets of genes may be genetically compared. In 16S-rRNA embodiments, OTUs that share at least 97% average nucleotide identity across the entire 16S or some variable region of the 16S are considered the same OTU (see e.g. Claesson M J, Wang Q, O'Sullivan O, Greene-Diniz R, Cole J R, Ros R P, and O'Toole P W. 2010. Comparison of two next-generation sequencing technologies for resolving highly complex microbiota composition using tandem variable 16S rRNA gene regions. Nucleic Acids Res 38: e200. Konstantinidis K T, Ramette A, and Tiedje J M. 2006. The bacterial species definition in the genomic era. Philos Trans R Soc Lond B Biol Sci 361: 1929-1940). In embodiments involving the complete genome, MLSTs, specific genes, or sets of genes OTUs that share at least 95% average nucleotide identity are considered the same OTU (see e.g. Achtman M, and Wagner M. 2008. Microbial diversity and the genetic nature of microbial species. Nat. Rev. Microbiol. 6: 431-440. Konstantinidis K T, Ramette A, and Tiedje J M. 2006. The bacterial species definition in the genomic era. Philos Trans R Soc Lend B Biol Sci 361: 1929-1940). OTUs are frequently defined by comparing sequences between organisms. Such characterization employs, e.g., WGS data or a whole genome sequence.

According to a specific embodiment, the classification is based on DNA-DNA pairing data and/or sequence identity to functionally conserved genes or fragments thereof.

According to a specific embodiment a species/strain can be defined by DNA-DNA hybridization (DDH) involving a pairwise comparison of two entire genomes and reflects the overall sequence similarity between them.

According to a specific embodiment, a species is defined as a set of strains with at least about 70%, e.g., at least about 75%, at least about 80%, at least about 85%, at least about 90%, at least about 91%, at least about 92%, at least about 93%, at least about 94%, at least about 95% or more DNA-DNA relatedness and with 5° C. or less of $\Delta$Tm (melting temperature) and having an activity of insect killing or of inhibiting development of an insect, e.g., the activities as defined per strain in Tables 33-41 below.

As used herein the term "$\Delta$Tm" refers to the difference between the melting temperatures (Tm) of a hybrid DNA [when a single strand (ss) DNA of organism "A" is hybridized with ssDNA of organism "B"] and of a homologous DNA [when a ssDNA of organism "A" is hybridized with ssDNA of the same organism "A"] under standard conditions determined as the temperature at which 50% of the double-strand DNA is in the form of single strands.

According to a specific embodiment, the genomic nucleic acid sequence of the functional homologous strain is at least about 97%, at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95% 99.95%, at least about 99.99%, at least about 99.999%, at least about 99.9999%, at least about 99.99999%, at least about 99.999999% or more DNA-DNA relatedness and with 5° C. or less of $\Delta$Tm and having an activity of insect killing or of inhibiting development of an insect, e.g., the activities as defined per strain in Tables 33-41 below.

Thus, for example, if there is DNA-DNA hybridization on the basis of the article of Goris et al. [Goris, J., Konstantinidis, K. T., Klappenbach, J. A., Coenye, T., Vandamme, P., and Tiedje, J M. (2007). DNA-DNA hybridization values and their relationship to whole-genome sequence similarities. Int J Syst Evol Microbiol 57:81-91], some microorganisms expressing a DNA-DNA relatedness value of 70% or more (as described above) can be regarded as functional homologs according to some embodiments of the invention.

A structure of a genome describes various elements existing in a genome. Such elements include, but not limited to, non-coding region(s), expression control region(s), replication control region(s), coding region(s), overlapping coding region(s), direction of coding sequence and/or the functionality of any of the above mentioned regions.

It is noted that once a genome sequence is obtained from a bacterial strain (e.g., of a deposited strain), the genome structure thereof can be obtained by known bioinformatics tools. For example, sequence reads are backed together into longer continuous stretches of sequences (contigs) by known computer algorithms, such as those described in Ekblom et al. (Ekblom, R., & Wolf, J. B. W. (2014). A field guide to whole-genome sequencing, assembly and annotation. Evolutionary Applications, 7(9), 1026-1042), which is fully incorporated herein by reference in its entirety. After the initial contig building, the contigs are further elongated into scaffolds and then a final stage in the pipeline is a gap-filling between the scaffolds. Obtained genome sequence is then annotated with biologically relevant information, such as protein coding sequences (CDS) and other relevant information.

As used herein and in the claims section below the phrase "similar" in the context of a genome structure refers to genome structures having at least 90%, at least 91%, at least 92%, at least 93%, at least 94%, at least 95%, at least 96%, at least 97%, at least 98%, at least 99% of their elements in existence and in respective relative positions to the genome structure of a certain bacterial isolate, e.g., of the bacterial isolate of some embodiments of the invention. For example if a first genome has 1000 elements arranged sequentially from 1-1000, it will be 95% similar to a second genome missing 50 of the 1000 element, however the remaining 950 elements are arranged in a sequential order as in the first genome, i.e., element N+X will always follow after N, N and X are positive integers, N+X equals or less than 950.

According to a specific embodiment, the genomic nucleic acid sequence of the functional homologous strain is at least about 70%, e.g., at least 75%, at least about 80%, at least about 85%, at least about 90%, at least about 91%, at least about 92%, at least about 93%, at least about 94%, at least about 95%, at least about 96% least about 97%, at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95% 99.95%, at least about 99.99%, at least about 99.999%, at least about 99.9999%, at least about 99.99999%, at least about 99.999999% or more similar to the genomic sequence of the deposited strain.

As used herein, "sequence identity" or "identity" or grammatical equivalents as used herein in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff JG. [Amino acid substitution matrices from protein blocks. Proc. Natl. Acad. Sci. U.S.A. 1992, 89(22): 10915-9].

Identity can be determined using any homology comparison software, including for example, the BlastN software of the National Center of Biotechnology Information (NCBI) such as by using default parameters.

According to some embodiments of the invention, the identity is a global identity, i.e., an identity over the entire nucleic acid sequences of the invention and not over portions thereof.

According to a specific embodiment, the genomic nucleic acid sequence of the functional homologous strain is at least about 70%, e.g., at least 75%, at least about 80%, at least about 85%, at least about 90%, at least about 91%, at least about 92%, at least about 93%, at least about 94%, at least about 95%, at least about 96% least about 97%, at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95% 99.95%, at least about 99.99%, at least about 99.999%, at least about 99.9999%, at least about 99.99999%, at least about 99.999999% or more identical to the genomic sequence of the deposited strain.

According to a specific embodiment, the genomic nucleic acid sequence of the functional homologous strain is at least about 97%, at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, 99.95%, at least about 99.99%, at least about 99.999%, at least about 99.9999%, at least about 99.99999%, at least about 99.999999% or more identical to that of the deposited strain.

According to an additional or alternative embodiment, a functional homolog is determined as the average nucleotide identity (ANI), which detects the DNA conservation of the core genome (Konstantinidis K and Tiedje J M, 2005, Proc. Natl. Acad. Sci. USA 102: 2567-2592). In some embodiments, the ANI between the functional homolog and the deposited strain is of at least about 95%, at least about, 96%, at least about 97%, at least about 98%, at least about 99%, at least about 99.1%, at least about 99.5%, at least about 99.6%, at least about 99.7%, at least about 99.8%, at least about 99.9%, at least about 99.99%, at least about 99.999%, at least about 99.9999%, at least about 99.99999%, at least about 99.999999% or more.

According to an additional or alternative embodiment, a functional homolog is determined by the degree of relatedness between the functional homolog and deposited strain determined as the Tetranucleotide Signature Frequency Correlation Coefficient, which is based on oligonucleotide frequencies (Bohlin J. el al. 2008, BMC Genomics, 9:104). In some embodiments, the Tetranucleotide Signature Frequency Correlation coefficient between the variant and the deposited strain is of about 0.99, 0.999, 0.9999, 0.99999, 0.999999, 0.9999999 or more.

According to an additional or alternative embodiment, the degree of relatedness between the functional homolog and the deposited strain is determined as the degree of similarity obtained when analyzing the genomes of the parent and of the variant strain by Pulsed-field gel electrophoresis (PFGE) using one or more restriction endonucleases. The degree of similarity obtained by PFGE can be measured by the Dice similarity coefficient [Sorensen, T. (1948). "A method of establishing groups of equal amplitude in plant sociology based on similarity of species and its application to analyses of the vegetation on Danish commons". Kongelige Danske Videnskabernes Selskab. 5 (4): 1-3; Dice, Lee R. (1945). "Measures of the Amount of Ecologic Association Between Species". Ecology. 26 (3): 297-302. doi:10.2307/1932409. JSTOR 1932409].

In some embodiments, the Dice similarity coefficient between the variant and the deposited strain is of at least about 96%, at least about 97%, at least about 98%, at least about 99%, at least about 99.1%, at least about 99.5%, at least about 99.6%, at least about 99.7%, at least about 99.8%, at least about 99.9%, at least about 99.99%, at least about 99.999%, at least about 99.9999%, at least about 99.99999%, at least about 99.999999% or more.

According to an additional or alternative embodiment, the functional homolog is defined as having the same ribotype, as obtained using any of the methods known in the art and described, for instance, by Bouchet et al. (Clin. Microbiol. Rev., 2008, 21:262-273). Ribotyping is a known molecular technique for bacterial identification and characterization that uses information from rRNA-based phylogenetic analyses [Madigan, Michael T. (2012). Biology of Microorganisms. Pearson. p. 491. ISBN 978-0-321-73551-5].

According to a specific embodiment, the bacterial strain comprises at least one 16S-rRNA (e.g., two 16S-rRNA).

According to a specific embodiment, the 16S ribosomal RNA (16S-rRNA) nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to some embodiments of the invention, the functionally homologous strain has at least 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more sequence identity to a genome of the biologically pure bacterial isolate strain or at least 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more sequence identity to a 16S rRNA of the biologically pure bacterial isolate strain.

According to an additional or alternative embodiment, the degree of relatedness between the functional homolog and the deposited strain is determined by the Pearson correlation coefficient obtained by comparing the genetic profiles of both strains obtained by repetitive extragenic palindromic element-based PCR (REP-PCR) (see e.g. Chou and Wang, Int J Food Microbiol. 2006, 110:135-48). In some embodiments, the Pearson correlation coefficient obtained by comparing the REP-PCR profiles of the variant and the deposited strain is of at least about 0.99, at least about 0.999, at least about 0.9999, at least about 0.99999, at least about 0.999999, at least about 0.9999999 or more.

According to an additional or alternative embodiment, the degree of relatedness between the functional homolog and the deposited strains is defined by the linkage distance obtained by comparing the genetic profiles of both strains obtained by Multilocus sequence typing (MLST) (see e.g. Maiden, M. C., 1998, Proc. Natl. Acad. Sci. USA 95:3140-3145). In some embodiments, the linkage distance obtained by MLST of the functional homolog and the deposited strain is of at least about 0.99, at least about 0.999, at least about 0.9999, at least about 0.99999, at least about 0.999999, at least about 0.9999999 or more.

According to an additional or alternative embodiment, the functional homolog comprises a functionally conserved gene or a fragment thereof e.g., a house-keeping gene e.g., 16S-rRNA or Internal Transcribed Spacer" (ITS), recA, glnII, atpD, gap, glnA, gltA, gyrB, pnp, rpoB, thrC or dnaK that is at least about 97%, at least about 98%, at least about 99%, at least about 99.1%, at least about 99.5%, at least about 99.6%, at least about 99.7%, at least about 99.8%, at least about 99.9%, at least about 99.99%, at least about 99.999%, at least about 99.9999%, at least about 99.99999%, at least about 99.999999% or more identical to that of the deposited strain.

As mentioned, and according to a specific additional or an alternative embodiment, a functional homolog can also be determined on the basis of a multilocus sequence analysis (MLSA) determination of various functionally conserved genes or fragments thereof e.g., at least one, 2, 3, 4, 5, 6, 7, 8, 9, 10, 11, 12, 13, 14, 15 or more functionally conserved genes or fragments thereof, such as of e.g., 16S, ITS, recA, glnII, atpD, gap, glnA, gltA, gyrB, pnp, rpoB, thrC and dnaK.

According to a specific embodiment, the ITS nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the recA nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the atpD nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the dnaK nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the glnII nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the gap nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the glnA nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the gltA nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the gyrB nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the pnp nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the rpoB nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the thrC nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

It should be noted that a bacterial isolate can be also characterized by biochemical profiling (e.g., biochemical fingerprinting) using for example, the GEN III redox chemistry (BIOLOG Inc. 21124 Cabot Blvd. Hayward Calif., 94545, USA), which can analyze both Gram-negative and Gram-positive bacteria, for their ability to metabolize all major classes of biochemicals, in addition to determining other important physiological properties such as pH, salt, and lactic acid tolerance. Further details can be obtained in "Modem Phenotypic Microbial Identification", B. R. Bochner, Encyclopedia of Rapid Microbiological Methods, 2006, v.2, Ch. 3, pp. 55-73, which is fully incorporated herein by reference in its entirety.

According to an additional or alternative embodiment the deposited strain and the functional homolog are characterized by substantially the same (+/−about 10%, 20%, 40%, 50%, 60% when tested under the same conditions) biochemical profiling (e.g., biochemical fingerprinting) using for example, the GEN III redox chemistry (BIOLOG Inc. 21124 Cabot Blvd. Hayward Calif., 94545, USA).

According to an additional or alternative embodiment, the functional homolog is defined by a comparison of coding sequences [gene(s)] order to that of a bacterial strain of interest (e.g., the deposited strain).

According to an additional or alternative embodiment, the functional homolog is defined by a comparison of order of non-coding sequences to that of a bacterial strain of interest (e.g., the deposited strain).

According to an additional or alternative embodiment, the functional homolog is defined by a comparison of order of coding and non-coding sequences to that of a bacterial strain of interest (e.g., the deposited strain).

According to an additional or alternative embodiment, the functionally homologous strain has substantially the same coding and/or non-coding sequence orientation as that of the bacterial isolate strain homologous thereto.

According to some embodiments of the invention, the combined coding region of the functional homolog is such that it maintains the original order of the coding regions as within the genomic sequence of the bacterial isolate yet without the non-coding regions.

For example, in case the genomic sequence has the following coding regions, A, B, C, D, E, F, G, each flanked by non-coding sequences (e.g., regulatory elements, introns and the like), the combined coding region will include a single nucleic acid sequence having the A+B+C+D+E+F+G coding regions combined together while maintaining the original order of their genome, yet without the non-coding sequences.

According to some embodiments of the invention, the combined non-coding region of the functional homolog is such that it maintains the original order of the non-coding regions as within the genomic sequence of the bacterial isolate (e.g., the deposited bacterial strain) yet without the coding regions as originally present in the bacterial deposit.

According to some embodiments of the invention, the combined non-coding region and coding region (i.e., the genome) of the functional homolog is such that it maintains the original order of the coding and non-coding regions as within the genomic sequence of the bacterial deposit.

As used herein "maintains" relate to at least about 90%, 91%, 92%, 93%, 94%, 95%, 96%, 97%, 98%, 99% or 100% is maintained as compared to the deposited strain.

According to an additional or alternative embodiment, the functional homolog is defined by a comparison of gene content.

According to a specific embodiment, the functional homolog comprises a combined coding region where at least about 90%, at least about 91%, at least about 92%, at least about 93%, at least about 94%, at least about 95%, at least about 96%, at least about 97%, at least about 98%, at least about 99%, or more (e.g., 100%) is identical to a combined coding region existing in genome of the deposited strain.

As used herein "combined coding region" refers to a nucleic acid sequence including all of the coding regions of the bacterial isolate yet without the non-coding regions of the bacterial isolate.

It should be noted that once a bacterial isolate is available and its genomic sequence is determined (e.g., by known sequencing methods and bioinformatics tools), the skilled person can easily identify the coding regions of the bacterial isolate, and can combine these coding regions into a single nucleic acid sequence.

According to an additional or alternative embodiment, the functional homolog is defined by a comparison of nucleotide composition and codon usage to the deposited bacterial strain or to a bacterial strain of interest.

According to an additional or alternative embodiment, the functional homolog is defined by a method based on random genome fragments and DNA microarray technology. These methods are of sufficiently high resolution to for strain-to-species level identification.

One of ordinary skill in the art, based on knowledge of the classification criteria would know how to identify strains that are considered functional homologs.

An additional and more detailed description of species-to-strain classification can be found in:

Cho and Tiedje 2001 Bacterial species determination from DNA-DNA hybridization by using genome fragments and DNA microarrays;

Coenye et al. 2005 Towards a prokaryotic genomic taxonomy. FEMS Microbiol. Rev. 29:147-167;

Konstantinidis and Tiedje (2005) Genomic insights that advance the species definition for prokaryotes. Proc. Natl. Acad. Sci. USA 102:189-197;

Konstantinidis et al. 2006 Toward a more robust assessment of intraspecies diversity using fewer genetic markers. Appl. Environ. Microbiol. 72:7286-7293.

It is to be understood that one or more methods as described herein can be used to identify a functional homolog.

Genomic data can be obtained by methods which are well known in the art e.g., DNA sequencing, bioinformatics, electrophoresis, an enzyme-based mismatch detection assay and a hybridization assay such as PCR, RT-PCR, RNase protection, in-situ hybridization, primer extension, Southern blot, Northern Blot and dot blot analysis.

According to a specific embodiment, the functional homolog and the deposited strain belong to the same genus.

According to a specific embodiment, the functional homolog and the deposited strain belong to the same species.

According to a specific embodiment, the functional homolog and the deposited strain belong to the same sub-species.

According to an aspect of some embodiments of the invention there is provided a biologically pure bacterial isolate characterized by a genome structure at least 90%, at least about 91%, at least about 92%, at least about 93%, at least about 94%, at least about 95%, at least about 96%, at least about 97%, at least about 98%, at least about 99%, %, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more (e.g., 100%) similar (e.g., identical) to a genome structure of a bacterial strain selected from the group consisting of:

*Bacillus amyloliquefaciens* A190 strain having an NRRL Accession No. B-67464,

*Bacillus subtilis* P243 strain having an NRRL Accession No. B-67459,

*Bacillus thuringiensis* M979 strain having an NRRL Accession No. B-67457,

*Massilia aurea* P63 strain having an NRRL Accession No. B-67461,

*Rhodococcus* sp. G706 strain,

*Stenotrophomonas maltophilia* E132 strain having an NRRL Accession No. B-67460,

*Streptomyces aurantiacus* A918 strain,

*Streptomyces badius* O180 strain,

*Streptomyces mirabilis* B670 strain having an NRRL Accession No. B67463,

*Streptomyces scopuliridis* F427 strain having an NRRL Accession No. B-67458,

*Streptomyces* sp. E128 strain having an NRRL Accession No. B-67462, and

*Streptomyces* sp. L219 strain.

According to an aspect of some embodiments of the invention there is provided a biologically pure bacterial isolate characterized by a genome at least 90%, at least about 91%, at least about 92%, at least about 93%, at least about 94%, at least about 95%, at least about 96%, at least about 97%, at least about 98%, at least about 99%, %, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more (e.g., 100%) identical to a genome of a bacterial strain selected from the group consisting of:

*Bacillus amyloliquefaciens* A190 strain having an NRRL Accession No. B-67464,

*Bacillus subtilis* P243 strain having an NRRL Accession No. B-67459,

*Bacillus thuringiensis* M979 strain having an NRRL Accession No. B-67457,

*Massilia aurea* P63 strain having an NRRL Accession No. B-67461,

*Rhodococcus* sp. G706 strain,

*Stenotrophomonas maltophilia* E132 strain having an NRRL Accession No. B-67460,

*Streptomyces aurantiacus* A918 strain,

*Streptomyces badius* O180 strain,

*Streptomyces mirabilis* B670 strain having an NRRL Accession No. B67463,

*Streptomyces scopuliridis* F427 strain having an NRRL Accession No. B-67458,

*Streptomyces* sp. E128 strain having an NRRL Accession No. B-67462, and

*Streptomyces* sp. L219 strain, and/or at least 90%, at least about 91%, at least about 92%, at least about 93%, at least about 94%, at least about 95%, at least about 96%, at least about 97%, at least about 98%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% identical to a combined coding region existing in genome of a bacterial strain selected from the group consisting of:

*Bacillus amyloliquefaciens* A190 strain having an NRRL Accession No. B-67464,

*Bacillus subtilis* P243 strain having an NRRL Accession No. B-67459,

*Bacillus thuringiensis* M979 strain having an NRRL Accession No. B-67457,

*Massilia aurea* P63 strain having an NRRL Accession No. B-67461,

*Rhodococcus* sp. G706 strain,

*Stenotrophomonas maltophilia* E132 strain having an NRRL Accession No. B-67460,

*Streptomyces aurantiacus* A918 strain,

*Streptomyces badius* O180 strain,

*Streptomyces mirabilis* B670 strain having an NRRL Accession No. B67463,

*Streptomyces scopuliridis* F427 strain having an NRRL Accession No. B-67458,

*Streptomyces* sp. E128 strain having an NRRL Accession No. B-67462, and

*Streptomyces* sp. L219 strain.

According to an aspect of some embodiments of the invention there is provided a biologically pure bacterial isolate characterized by a genome at least about 90%, at least about 91%, at least about 92%, at least about 93%, at least about 94%, at least about 95%, at least about 96%, at least about 97%, at least about 98%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more (e.g., 100%) identical to a genome of a bacterial species selected from the group consisting of:

*Bacillus amyloliquefaciens* A190 strain having an NRRL Accession No. B-67464,

*Bacillus subtilis* P243 strain having an NRRL Accession No. B-67459,

*Bacillus thuringiensis* M979 strain having an NRRL Accession No. B-67457,

*Massilia aurea* P63 strain having an NRRL Accession No. B-67461,

*Rhodococcus* sp. G706 strain,

*Stenotrophomonas maltophilia* E132 strain having an NRRL Accession No. B-67460,

*Streptomyces aurantiacus* A918 strain,

*Streptomyces badius* O180 strain,

*Streptomyces mirabilis* B670 strain having an NRRL Accession No. B67463,

*Streptomyces scopuliridis* F427 strain having an NRRL Accession No. B-67458,

*Streptomyces* sp. E128 strain having an NRRL Accession No. B-67462, and

*Streptomyces* sp. L219 strain.

According to an aspect of some embodiments of the invention there is provided a biologically pure bacterial isolate characterized by a combined coding region at least about 90%, at least about 91%, at least about 92%, at least about 93%, at least about 94%, at least about 95%, at least about 96%, at least about 97%, at least about 98%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more (e.g., 100%) identical to the combined coding region existing in genome of a bacterial strain selected from the group consisting of:

*Bacillus amyloliquefaciens* A190 strain having an NRRL Accession No. B-67464,

*Bacillus subtilis* P243 strain having an NRRL Accession No. B-67459,

*Bacillus thuringiensis* M979 strain having an NRRL Accession No. B-67457,

*Massilia aurea* P63 strain having an NRRL Accession No. B-67461,

*Rhodococcus* sp. G706 strain,

*Stenotrophomonas maltophilia* E132 strain having an NRRL Accession No. B-67460,

*Streptomyces aurantiacus* A918 strain,

*Streptomyces badius* O180 strain,

*Streptomyces mirabilis* B670 strain having an NRRL Accession No. B67463,

*Streptomyces scopuliridis* F427 strain having an NRRL Accession No. B-67458,

*Streptomyces* sp. E128 strain having an NRRL Accession No. B-67462, and

*Streptomyces* sp. L219 strain.

According to some embodiments of the invention, the biologically pure bacterial isolate is a strain selected from the group consisting of:

*Bacillus amyloliquefaciens* A190 strain having an NRRL Accession No. B-67464,

*Bacillus subtilis* P243 strain having an NRRL Accession No. B-67459,

*Bacillus thuringiensis* M979 strain having an NRRL Accession No. B-67457,

*Massilia aurea* P63 strain having an NRRL Accession No. B-67461,

*Rhodococcus* sp. G706 strain,

*Stenotrophomonas maltophilia* E132 strain having an NRRL Accession No. B-67460,

*Streptomyces aurantiacus* A918 strain,

*Streptomyces badius* O180 strain,

*Streptomyces mirabilis* B670 strain having an NRRL Accession No. B67463,

*Streptomyces scopuliridis* F427 strain having an NRRL Accession No. B-67458,

*Streptomyces* sp. E128 strain having an NRRL Accession No. B-67462, and

*Streptomyces* sp. L219 strain.

The present inventors have determined the nucleic acid sequence of the 16S rRNA of the biologically pure bacterial isolates (which were either deposited or not deposited in the NRRL depository) using known sequencing methods such as whole genome sequencing using the Illumina® Technology. Additional methods which are suitable for determination of the 16 rRNA include the 16S rRNA specific amplicons as described for example, in "Thompson, L. R., et al., 2017. "The Earth Microbiome Project Consortium. (2017). A communal catalogue reveals Earth's multiscale microbial diversity. Nature, 551:457-463, which is fully incorporated herein by reference in its entirety). Table 1 hereinbelow presents the nucleotide sequences of the 16S rRNA of the biologically pure bacterial isolates of some embodiments of the invention.

TABLE 1

Provided are the polynucleotide (Polyn.) sequences of the 16S rRNA of the biologically pure bacterial isolates of some embodiments of the invention.

| Bacterial Strain Reference Number | Bacterial isolate complete name | Polyn. SEQ ID NO: of 16SrRNA | Deposit No |
|---|---|---|---|
| A190 | *Bacillus amyloliquefaciens* A190 | 764 | NRRL B-67464 |
| A918 | *Streptomyces aurantiacus* A918 | 758 | — |

TABLE 1-continued

Provided are the polynucleotide (Polyn.) sequences of the 16S rRNA of the biologically pure bacterial isolates of some embodiments of the invention.

| Bacterial Strain Reference Number | Bacterial isolate complete name | Polyn. SEQ ID NO: of 16SrRNA | Deposit No |
|---|---|---|---|
| B670 | Streptomyces mirabilis B670 | 759 | NRRL B-67463 |
| E128 | Streptomyces sp. E128 | 760 | NRRL B-67462 |
| E132 | Stenotrophomonas maltophilia E132 | 757 | NRRL B-67460 |
| F427 | Streptomyces scopuliridis F427 | 761 | NRRL B-67458 |
| G706 | Rhodococcus sp. G706 | 756 | — |
| L219 | Streptomyces sp. L219 | 762 | — |
| M979 | Bacillus thuringiensis M979 | 753 | NRRL B-67457 |
| O180 | Streptomyces badius O180 | 763 | — |
| P243 | Bacillus subtilis P243 | 754 | NRRL B-67459 |
| P63 | Massilia aurea P63 | 755 | NRRL B-67461 |

According to a specific embodiment, the 16S ribosomal RNA (16S-rRNA) nucleic acid sequence of the functional homologous strain is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to the nucleic acid sequence selected from the group consisting of SEQ ID NOs: 753-764.

According to an aspect of some embodiments of the invention there is provided a biologically pure bacterial isolate comprising a 16S ribosomal RNA (16S rRNA) nucleic acid sequence at least about 97%, e.g., at least 97.1%, at least 97.2%, at least 97.3%, at least 97.4%, at least 97.5%, at least 97.6%, at least 97.7%, at least 97.8%, at least 97.9%, at least 98%, at least 98.1%, at least 98.2%, at least 98.3%, at least 98.4%, at least 98.5%, at least 98.6%, at least 98.7%, at least 98.8%, at least 98.9%, at least 99%, at least 99.1%, at least 99.2%, at least 99.3%, at least 99.4%, at least 99.5%, at least 99.6%, at least 99.7%, at least 99.8%, at least 99.8%, at least 99.9%, at least about 99.95%, at least about 99.999%, at least about 99.9999%, at least about 99.99999%, at least about 99.999999% or more identical to the polynucleotide sequence selected from the group consisting of SEQ ID NOs: 753-764.

As described in Examples 1, 2 and 3 of the Examples section which follows, once the bacterial isolates were identified (Table 11, Example 1) and their genomic sequence was determined, the present inventors have identified the coding sequences of polypeptides having the insect killing or inhibitory activity. Thus, Table 22 in Example 4 of the Examples section which follows summarizes the polynucleotides (SEQ ID NOs: 1-50) and polypeptides (SEQ ID NOs: 249-298) uncovered from the bacterial isolates of some embodiments of the invention, and Table 28 in Example 5 of the Examples section which follows provides additional orthologous and homologous polynucleotides (SEQ ID NOs: 51-248) and polypeptides (SEQ ID NOs: 249-298) having the same insect killing or inhibitory activity.

According to an aspect of some embodiments of the invention, there is provided a biologically pure bacterial isolate comprising in a genome thereof a coding sequence of polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more (e.g., 100%) homologous to an amino acid sequence selected from the group consisting of SEQ ID NOs: 249-495, 552-607, and 656-697.

According to an aspect of some embodiments of the invention, there is provided a biologically pure bacterial isolate comprising in a genome thereof a coding sequence of polypeptide comprising an amino acid sequence having at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more (e.g., 100%) sequence identity to an amino acid sequence selected from the group consisting of SEQ ID NOs: 249-495, 552-607, and 656-697.

The phrase "protein family" as used herein refers to a group of proteins that share a common evolutionary origin, reflected by their functions and similarities in sequence and/or structure.

According to some embodiments of the invention, members of the protein family of some embodiments of the invention share a common evolutionary origin, sequence similarity, conserved protein domains, and the same function of killing or inhibiting development of an insect.

Usually, the protein families are arranged into hierarchies, with proteins sharing a common ancestor subdivided into smaller groups. Various methods and algorithms can be used to determine protein families.

For example, the present inventors used the MEGA7 software [Molecular Evolutionary Genetics Analysis, version 7.0 (Kumar S, Stecher G, and Tamura K., 2016, "MEGA7: Molecular Evolutionary Genetics Analysis version 7.0 for bigger datasets".

Molecular Biology and Evolution 33:1870-1874] and the neighbor joining statistical model [created by Naruya Saitou and Masatoshi Nei. "The neighbor-joining method: a new method for reconstructing phylogenetic trees." Molecular Biology and Evolution, volume 4, issue 4, pp. 406-425, July 1987] using default parameters to generate phylogenetic trees for the identified proteins having insecticidal activity.

The phylogenetic trees depicted for MBI4 (SEQ ID NO: 250; FIG. 1A), MBI22 (SEQ ID NO: 257; FIG. 1B) and MB127 (SEQ ID NO: 259; FIG. 1C) are evolutionary trees composed of the parental genes and their active orthologues.

For example, as shown in FIG. 1A and Table 23, genes of the MBI4 family exhibit at least 81.4% global sequence identity between family members, e.g., between SEQ ID NOs: 315 and 296, e.g., between 81.4-100% sequence identity. As shown in FIG. 1B and Tables 24-25, genes of the MBI22 family exhibit at least 70% global sequence identity between family members, e.g., between SEQ ID NO: 465 and 470, or between SEQ ID NOs: 386 and 470, e.g., between 70-100% sequence identity. Similarly, as shown in FIG. 1C and Tables 26-27, genes of the MB 27 family exhibit as low as 29% global identity between the family members, e.g., between SEQ ID NOs: 481 and 485, e.g., between 29% to 100% sequence identity. In addition, the phylogenetic trees also show that all polypeptides of a gene family tree comprise the same conserved domains as the other members of that gene family [e.g., the MBI4 (FIG. 1A), MBI22 (FIG. 1B) and MBI27 (FIG. 1C)]. Furthermore, as shown in FIGS. 1A-C and Tables 22-26, all members of these gene families exhibit the same insecticidal activity. Thus, polypeptides which are not explicitly disclosed herein yet exhibiting at least 29%, to the polypeptide selected from the group consisting of SEQ ID NOs: 259, 286-295, 393-395, and 472-485; or at least 70% global sequence identity to the polypeptide selected from the group consisting of SEQ ID NOs: 257, 284-285, 377-387 and 457-471; or at least 81% global sequence identity to the polypeptide selected from the group consisting of SEQ ID NOs: 250, 296, 306-315 and 486-490, and exhibit at least one (e.g., at least two or all three) of the conserved domains of MBI4, MB122 and MBI27 (as specified in Tables 26 and 27), are expected to become embedded in one of those phylogenetics trees, instead of forming outgroups, and thus, polypeptides which are embedded in at least one of those phylogenetics trees exhibit the same insecticidal activity.

According to an aspect of some embodiments of the invention, there is provided a biologically pure bacterial isolate comprising in a genome thereof a coding sequence of at least one polypeptide selected from the group consisting of:

(i) a polypeptide comprising an amino acid sequence comprising at least one domain characterized by an InterPro accession number selected from the group consisting of: IPR005546 and IPR006315 and exhibiting at least 70%, at least 75%, at least 80%, at least 85%, at least 90%, at least 95% or more sequence identity to the amino acid sequence selected from the group consisting of SEQ ID NOs: 257, 284-285, 377-387 and 457-471, wherein the polypeptide belongs to the same protein family as SEQ ID NOs: 257, 284-285, 377-387 and 457-471 and having an insect killing or inhibitory activity;

(ii) a polypeptide comprising an amino acid sequence comprising a domain characterized by an InterPro accession number IPR027295 and exhibiting at least 81%, at least 82%, at least 85%, at least 90%, at least 95% or more sequence identity to the amino acid sequence selected from the group consisting of SEQ ID NOs: 250, 296, 306-315 and 486-490, wherein the polypeptide belongs to the same protein family as SEQ ID NOs: 250, 296, 306-315 and 486-490 and having an insect killing or inhibitory activity; and (iii) a polypeptide comprising an amino acid sequence comprising at least one domain characterized by an InterPro accession number selected from the group consisting of: IPR011658, IPR003961 and IPR0137833 and exhibiting at least 29%, at least 30%, at least 35%, at least 40%, at least 50%, at least 55%, at least 60%, at least 65%, at least 70%, at least 75%, at least 80%, at least 85%, at least 90%, at least 95% or more sequence identity to the amino acid sequence selected from the group consisting of SEQ ID NOs: 259, 286-295, 393-395, and 472-485, wherein the polypeptide belongs to the same protein family as SEQ ID NOs: 259, 286-295, 393-395, and 472-485 and having an insect killing or inhibitory activity.

According to some embodiments of the invention, the polypeptide in (iii) comprises the domains characterized by InterPro accession numbers IPR011658, IPR003961 and IPR0137833, According to some embodiments of the invention, wherein the polypeptide in (i) is selected from the group consisting of SEQ ID NOs: 257, 284-285, 377-387 and 457-471, wherein the polypeptide in (ii) is selected from the group consisting of SEQ ID NOs: 250, 296, 306-315, and 486-490, and wherein the polypeptide in (iii) is selected from the group consisting of SEQ ID NOs: 259, 286-295, 393-395, 472-485.

According to some embodiments of the invention, wherein the polypeptide in (ii) is selected from the group consisting of SEQ ID NOs: 250, 296, 306-315, and 486-490.

According to some embodiments of the invention, wherein the polypeptide in (i) is selected from the group consisting of SEQ ID NOs: 257, 284-285, 377-387 and 457-471.

According to some embodiments of the invention, wherein the polypeptide in (iii) is selected from the group consisting of SEQ ID NOs: 259, 286-295, 393-395, 472-485.

According to some embodiments of the invention, the polypeptide is embedded in a phylogenetic tree selected from the group consisting of the phylogenetic trees depicted in FIG. 1A, FIG. 1B and FIG. 1C, as determined by the MEGA7 software and a neighbor joining statistical method using the MEGA7 default parameters.

The default parameters for the MEGA7 software are as follows: Test of Phylogeny: Bootstrap method; No. of Bootstrap Replications: 1000; Substitution Model Mode/Method: Poisson model; Rates among Sites: Uniform rates; Gaps/ Missing Data Treatment: Complete deletion; Cut-off Value for Condensed Tree: 50%.

According to an aspect of some embodiments of the invention there is provided a biologically pure bacterial isolate comprising in a genome thereof a polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more (e.g., 100%) identical to a nucleic acid sequence selected from the group consisting of SEQ ID NOs: 1-248, 496-551, and 656-697.

According to an aspect of some embodiments of the invention, there is provided a kit comprising a bacterial DNA, at least one DNA sequencing agent, and a software for determination of coding region(s) in the bacterial DNA, wherein the bacterial DNA is obtained from the biologically pure bacterial isolate of some embodiments of the invention, the biologically pure modified bacterial isolate of some embodiments of the invention, the modified bacterial isolate resultant of the method of some embodiments of the invention, or the composition-of-matter of some embodiments of the invention.

Known software for determination of the coding region(s) of a bacterial DNA include, but are not limited to Prodigal Gene Prediction Software, e.g., using version 2.6.3 (Prodigal: prokaryotic gene recognition and translation initiation site identification. Reviewed by Doug Hyatt, et al., 2010. BMC Bioinformatics. 11: 119).

DNA sequencing agents are widely used in various DNA sequencing technologies such as Sanger, 454, Illumina, SOLiD, ion torrent, PACBIO and Oxford NANOPORE.

According to an embodiment of the invention, the cells of the biologically pure bacterial isolate are dead bacterial cells.

As used herein the phrase a "dead bacterial cell" refers to cell lacking the ability to proliferate and to metabolize any substrate or nutrient.

There are various methods for killing bacterial cells. These include, for example, heat killing, e.g., using a temperature of at least 60° C. for a duration of 2 hours, alternatively, e.g., of at least 70° C., at least 80° C., at least 90° C., or more, e.g., about 100° C. Alternatively or additionally, bacterial cells can be killed by chemical lysis (e.g., using a detergent such as sodium dodecyl sulfate), or physical lysis (e.g., by sonication).

According to some embodiments of the invention, the dead bacterial cells are obtainable by a method selected from the group consisting of: heat killing, chemical lysis, and physical lysis.

According to an aspect of some embodiments of the present invention there is provided whole cell broth collected from fermentation of the biologically pure bacterial isolate of some embodiments of the invention.

According to an aspect of some embodiments of the present invention there is provided whole cell broth collected from fermentation of a biologically pure bacterial isolate comprising a bacterial strain selected from the group consisting of:

*Bacillus amyloliquefaciens* A190 strain having an NRRL Accession No. B-67464,

*Bacillus subtilis* P243 strain having an NRRL Accession No. B-67459,

*Bacillus thuringiensis* M979 strain having an NRRL Accession No. B-67457,

*Massilia aurea* P63 strain having an NRRL Accession No. B-67461,

*Rhodococcus* sp. G706 strain,

*Stenotrophomonas maltophilia* E132 strain having an NRRL Accession No. B-67460,

*Streptomyces aurantiacus* A918 strain,

*Streptomyces badius* O180 strain,

*Streptomyces mirabilis* B670 strain having an NRRL Accession No. B67463,

*Streptomyces scopuliridis* F427 strain having an NRRL Accession No. B-67458,

*Streptomyces* sp. E128 strain having an NRRL Accession No. B-67462, and

*Streptomyces* sp. L219.

According to some embodiments of the invention the bacteria is lysed.

According to an aspect of some embodiments of the invention, there is provided a lysate or whole cell broth of the biologically pure bacterial isolate of some embodiments of the invention.

As used herein and in the claims section below, the term "lysate" refers to the result of a membrane rupture or dissociation such as by solubilization.

Methods of lysing bacterial cells are known in the art (e.g., Anthony C. Grabski, Chapter 18: Advances in Preparation of Biological Extracts for Protein Purification, Methods in Enzymology, Volume 463, 2009, Pages 285-303, ISSN 0076-6879, which is fully incorporated by reference in its entirety) and include, for example, sonication as exemplified in Examples 6 and 8 of the Examples section which follows.

According to some embodiments of the invention, the lysate or whole cell broth of some embodiments of the invention is capable of killing or inhibiting the development of an insect.

According to some embodiments of the invention, the lysate of some embodiments of the invention comprising a whole cell lysate of a bacterial preparation.

Following is a non-limiting description of a method of whole cell lysis of bacterial cells. A single colony from an LB plate is inoculated into a suitable medium (e.g., 2×YT auto-induction media) at 37° C. with shaking at 250 RPM for 16-18 hours. After incubation, cells are pelleted at 10,000 g at 4° C. and resuspended in 4 ml ice-cold 20 mM Tris-HCl, for a concentration factor of 10×. Cells are pelleted at 10,000 g and pellets are resuspended in 4 ml 20 mM Tris-HCl. Cells are then lysed by sonication on ice at 40% power for a total time of 2:00 minutes in cycles of 7 second bursts and 20 seconds rest. It is noted that the conditions of sonication can vary by the skilled person. For example, as exemplified in Example 6 of the Examples section which follows, whole cell lysates can be prepared by sonicating the bacterial pellets in 20 mM potassium phosphate pH 8.0 using the medium settings for 6 seconds with 2 minutes intervals on ice for 4-5 times.

According to some embodiments of the invention, the lysate of some embodiments of the invention comprising a soluble fraction of a bacterial preparation.

Methods of preparing a soluble fraction of a bacterial preparation are well known in the art (e.g., Anthony C. Grabski, Chapter 18 Advances in Preparation of Biological Extracts for Protein Purification, Methods in Enzymology, Volume 463, 2009, Pages 285-303, ISSN 0076-6879, which is fully incorporated by reference in its entirety), and include, for example, use of beads to bind to the soluble fraction, followed by elution, removal of salts and centrifugation for concentrating the soluble fraction.

Following is a non-limiting description of a method of preparing a soluble fraction of a bacterial preparation. The supernatant fraction containing soluble protein is incubated with Ni-NTA beads for about 1 hour at 4° C. on a rotatory shaker with gentle shaker speed. The beads are preferably washed with a binding buffer (e.g., 20 mM potassium phosphate pH 8.0, 300 mM NaCl and 10 mM imidazole) prior to addition of supernatant fraction. The Ni-NTA-protein bound beads are collected by centrifugation at 1,200 rpm/4° C./5 minutes. The Ni-NTA-protein bound beads are then washed with a washing buffer (20 mM potassium phosphate pH 8.0, 300 mM NaCl and 20 mM imidazole) for 3 times. The bound proteins are eluted with elution buffer (20 mM potassium phosphate pH 8.0, 300 mM NaCl and 250 mM imidazole). The salts in the eluted proteins are removed using for example, 0.5 mL Zebra Spin desalting columns equilibrated with 20 mM potassium phosphate pH 8.0. SDS-PAGE analysis is used to quantify protein using known concentrations of bovine serum albumin (BSA) as standard.

According to some embodiments of the invention, the lysate of some embodiments of the invention comprising inclusion bodies of a bacterial preparation.

Methods of preparing inclusion bodies of a bacterial preparation are well known in the art (e.g., Anthony C. Grabski, Chapter 18 Advances in Preparation of Biological Extracts for Protein Purification, Methods in Enzymology, Volume 463, 2009, Pages 285-303, ISSN 0076-6879, which is fully incorporated by reference in its entirety), and include, for example, centrifugation and washing steps to obtain a cell pellet with inclusion bodies.

Following is a non-limiting description of a method of preparing inclusion bodies of the bacterial preparation. A culture of bacterial cell is centrifuged, and the pellet fraction containing inclusion bodies and cell debris is washed using e.g., a wash solution containing 20 mM potassium phosphate pH 8.0 and 0.1% triton. Then the pellet fraction is resuspended in 20 mM potassium phosphate pH 8.0 and the proteins in the inclusion bodies can be quantified using 1:10 and 1:20 dilution on SDS-PAGE using known concentrations of bovine serum albumin (BSA) as standard.

According to an aspect of some embodiments of the invention, there is provided a biologically pure modified bacterial isolate having an improved insect killing or inhibitory activity as compared to a biologically pure bacterial isolate of the same species according to some embodiments of the invention, wherein the modified bacterial isolate is a non-genetically modified organism (non-GMO).

According to some embodiments of the invention, the non-genetically modified organism is an organism not being subject to DNA recombinant techniques and/or to genome editing techniques.

It should be noted that a modified bacterial isolate with the improved insect killing or inhibitory activity can be obtained during the expansion of the bacterial isolate in culture, under conditions which allow evolvement of at least one bacterial mutant having the improved properties.

According to an aspect of some embodiments of the invention, there is provided a method of obtaining a modified bacterial isolate having an improved insect killing or inhibitory activity as compared to a biologically pure bacterial isolate of the same species according to some embodiments of the invention, comprising:

(a) culturing the bacterial isolate according to some embodiments of the invention under conditions suitable for expanding a population of the bacterial isolate and allowing evolvement of at least one bacterial mutant, and (b) selecting the at least one bacterial mutant resultant of step (a) for an improved insect killing or inhibitory activity, thereby obtaining the modified bacterial isolate having the improved insect killing or inhibitory activity as compared to the biologically pure bacterial isolate of the same species according to some embodiments of the invention.

According to some embodiments of the invention, the conditions comprise mutation-inducing conditions. Non-limiting examples of such mutation-inducing conditions include, but are not limited to exposure to physical mutagens as high temperature, dryness, extreme pH, UV or ionizing radiation, exposure to chemical mutagens as Reactive Oxygen Species (ROS), metals, intercalating agents, deaminating agents, alkylating agents, cross-linkers or other chemicals that interact differently with DNA. Mutations may also arise due to natural radioactive decay and biological processes as random mutagenesis, error-prone transcription or horizontal gene transfer.

It should be noted that bacterial isolates with improved insect inhibitory and/or killing activity may have a mutation in the genomic sequence encoding a polypeptide having the insect killing and/or inhibitory activity (e.g., a polypeptide comprising an amino acid sequence at least 80% identical to the polypeptide set forth by SEQ ID NOs: 249-495, 552-607, 656-697). Such a mutation can result, for example, with an improved activity of such a polypeptide [e.g., gain of function mutation(s)]. Additionally or alternatively, a bacterial isolate with an improved insect inhibitory and/or killing activity may have a mutation in a genomic sequence encoding a polypeptide or an RNA sequence which inhibits a repressor negatively affecting expression of the polypeptide of interest [e.g., loss-of-function mutation(s)] thus achieving upregulation of the activity of the polypeptide of interest, such as a polypeptide comprising an amino acid sequence at least 80% identical to the polypeptide set forth by SEQ ID NOs: 249-495, 552-607, 656-697.

Non-limiting examples of gain-of-function mutations include, but are not limited to a missense mutation, i.e., a mutation which changes an amino acid residue in the protein with another amino acid residue and thereby increases the enzymatic activity of the protein; a duplication of a whole coding sequence thus resulting in increased expression levels and activity of the polypeptide of interest; a mutation in a regulatory sequence such as a promoter, which results in increased transcription of the gene encoding the polypeptide; and the like.

Non-limiting examples of loss-of-function alterations include a missense mutation, i.e., a mutation which changes an amino acid residue in the protein with another amino acid residue and thereby abolishes the enzymatic activity of the protein; a nonsense mutation, i.e., a mutation which introduces a stop codon in a protein, e.g., an early stop codon which results in a shorter protein devoid of the enzymatic activity; a frame-shift mutation, i.e., a mutation, usually, deletion or insertion of nucleic acid(s) which changes the reading frame of the protein, and may result in an early termination by introducing a stop codon into a reading frame (e.g., a truncated protein, devoid of the enzymatic activity), or in a longer amino acid sequence (e.g., a readthrough protein) which affects the secondary or tertiary structure of the protein and results in a non-functional protein, devoid of the enzymatic activity of the non-mutated polypeptide; a readthrough mutation due to a frame-shift mutation or a modified stop codon mutation (i.e., when the stop codon is mutated into an amino acid codon), with an abolished enzymatic activity, a promoter mutation, i.e., a mutation in a promoter sequence, usually 5' to the transcription start site of a gene, which results in down-regulation of a specific gene product; a regulatory mutation, i.e., a mutation in a region upstream or downstream, or within a gene, which affects the expression of the gene product; a deletion mutation, i.e., a mutation which deletes coding nucleic acids in a gene sequence and which may result in a frame-shift mutation or an in-frame mutation (within the coding sequence, deletion of one or more amino acid codons); an insertion mutation, i.e., a mutation which inserts coding or non-coding nucleic acids into a gene sequence, and which may result in a frame-shift mutation or an in-frame insertion of one or more amino acid codons; an inversion, i.e., a mutation which results in an inverted coding or non-coding sequence; a splice mutation i.e., a mutation which results in abnormal splicing or poor splicing, and a duplication mutation, i.e., a mutation which results in a duplicated coding or non-coding sequence, which can be in-frame or can cause a frame-shift.

According to some embodiments of the invention, the selecting in step (b) is for a bacterial mutant having a mutation (e.g., a gain-of-function mutation) in a polynucleotide encoding a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more homologous to an amino acid sequence selected from the group consisting of SEQ ID NOs: 249-495, 552-607, and 656-697.

According to some embodiments of the invention, the selecting in step (b) is for a bacterial mutant having a mutation (e.g., a gain-of-function mutation) in a polynucleotide encoding a polypeptide comprising an amino acid sequence having at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more sequence identity to an amino acid sequence selected from the group consisting of SEQ ID NOs: 249495, 552-607, and 656-697.

According to some embodiments of the invention, the selecting in step (b) is for a bacterial mutant having a mutation (e.g., a gain-of-function mutation) in a polynucleotide comprising a nucleic acid sequence having at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more sequence identity to the nucleic acid sequence selected from the group consisting of SEQ ID NOs: 1-248, 496-551.

According to some embodiments of the invention, the mutation results in an increased activity of the polypeptide as compared to the activity level of the polypeptide in the biologically pure bacterial isolate of the same species according to some embodiments of the invention.

For example, the activity of the polypeptide of the modified bacterial isolate can be at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, at least about 99%, e.g., at least about 100%, e.g., at least about 150%, e.g., at least about 200%, e.g., at least about 250%, e.g., at least about 300%, e.g., at least about 400%, e.g., at least about 500%, e.g., at least about 600%, e.g., at least about 700%, e.g., at least about 800%, e.g., at least about 900%, e.g., at least about 1000%, e.g., at least about 2000% or more higher than the activity of a wild type polypeptide derived from a bacterial isolate of the species under the same (e.g., identical) growth and/or assay conditions.

According to some embodiments of the invention, the method of some embodiments of the invention further comprising qualifying the modified bacterial isolate for an improved insect killing or inhibitory activity as compared to the biologically pure bacterial isolate of the same species according to some embodiments of the invention.

Methods of qualifying the modified bacterial isolate for an improved insect killing or inhibitory activity as compared to the biologically pure bacterial isolate of the same species according to some embodiments of the invention are known in the art and include, for example, testing the inhibitory activity of the bacterial isolates on various insects, such as using the methods described in Examples 6-9 of the Examples section which follows. It should be noted that the bacterial isolates with increased effect on the insect, e.g., having a lower $IC_{50}$, yet without being subjected to any man-made genetic modifications, are identified and further qualified as bacterial isolates with improved insect killing and/or inhibitory activity.

According to an aspect of some embodiments of the invention, there is provided a biologically pure modified bacterial isolate having an improved insect killing or inhibitory activity as compared to a biologically pure bacterial isolate of the same species according to some embodiments of the invention, wherein the biologically pure modified bacterial isolate over-expresses a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more homologous or identical to an amino acid sequence selected from the group consisting of SEQ ID NOs: 249-495, 552-607, and 656-697.

According to some embodiments of the invention, overexpression of the polypeptide in the biologically pure modified bacterial isolate of some embodiments of the invention is obtainable by a technique selected from the group consisting of genome editing, transformation and transfection, each of which is well known in the art. Examples of such methods are provided hereinunder.

According to an aspect of some embodiments of the invention, there is provided a lysate or whole cell broth prepared from the biologically pure modified bacterial isolate of some embodiments of the invention, or from the modified bacterial isolate resultant of the method of some embodiments of the invention.

According to an aspect of some embodiments of the invention, there is provided an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more homologous or identical to an amino acid sequence selected from the group consisting of SEQ ID NOs: 249-495, 552-607, 632-655 and 656-697.

According to an aspect of some embodiments of the invention, there is provided an isolated polypeptide belonging to the protein family of MBI4, wherein the isolated protein belonging to the protein family of MBI4 shares a common evolutionary origin as the MBI4 protein family represented by SEQ ID NOs: 250, 296, 306-315 and 486-

490, having InterPro accession number IPR027295, exhibiting at least 81%, at least 82%, at least 85%, at least 90%, at least 95% or more sequence identity to the amino acid sequence selected from the group consisting of SEQ ID NOs: 250, 296, 306-315 and 486-490, and being capable of killing or inhibiting the development of an insect.

According to an aspect of some embodiments of the invention, there is provided an isolated polypeptide belonging to the protein family of MBI22, wherein the isolated protein belonging to the protein family of MBI22 shares a common evolutionary origin as the MBI22 protein family represented by SEQ ID NOs: 257, 284-285, 377-387 and 457-471, having InterPro accession number IPR005546 and IPR006315, exhibiting at least 70%, at least 75%, at least 80%, at least 85%, at least 90%, at least 95% or more sequence identity to the amino acid sequence selected from the group consisting of SEQ ID NOs: 257, 284-285, 377-387 and 457-471, and being capable of killing or inhibiting the development of an insect.

According to an aspect of some embodiments of the invention, there is provided an isolated polypeptide belonging to the protein family of MBI27, wherein the isolated protein belonging to the protein family of MBI27 shares a common evolutionary origin as the MBI27 protein family represented by SEQ ID NOs: 259, 286-295, 393-395, and 472-485, having InterPro accession number IPR011658, IPR003961 and IPR0137833, exhibiting at least 29%, at least 30%, at least 35%, at least 40%, at least 50%, at least 55%, at least 60%, at least 65%, at least 70%, at least 75%, at least 80%, at least 85%, at least 90%, at least 95% or more sequence identity to the amino acid sequence selected from the group consisting of SEQ ID NOs: 259, 286-295, 393-395, and 472-485, and being capable of killing or inhibiting the development of an insect.

According to some embodiments of the invention, members of the protein family of some embodiments of the invention share a common evolutionary origin, sequence similarity, conserved protein domains, and the same function of killing or inhibiting development of an insect.

According to an aspect of some embodiments of the invention, there is provided an isolated polypeptide selected from the group consisting of:

(i) a polypeptide comprising an amino acid sequence comprising at least one domain characterized by an InterPro accession number selected from the group consisting of: IPR005546 and IPR006315 and exhibiting at least 70%, at least 75%, at least 80%, at least 85%, at least 90%, at least 95% or more sequence identity to the amino acid sequence selected from the group consisting of SEQ ID NOs: 257, 284-285, 377-387 and 457-471, wherein the polypeptide belongs to the same protein family as SEQ ID NOs: 257, 284-285, 377-387 and 457-471 and having an insect killing or inhibitory activity;

(ii) a polypeptide comprising an amino acid sequence comprising a domain characterized by an InterPro accession number IPR027295 and exhibiting at least 81%, at least 82%, at least 85%, at least 90%, at least 95% or more sequence identity to the amino acid sequence selected from the group consisting of SEQ ID NOs: 250, 296, 306-315 and 486-490, wherein the polypeptide belongs to the same protein family as SEQ ID NOs: 250, 296, 306-315 and 486-490 and having an insect killing or inhibitory activity; 250, 296, 306-315, and 486-490; and (iii) a polypeptide comprising an amino acid sequence comprising at least one domain characterized by an InterPro accession number selected from the group consisting of: IPR011658, IPR003961 and IPR0137833 and exhibiting at least 29%, at least 30%, at least 35%, at least 40%, at least 50%, at least 55%, at least 60%, at least 65%, at least 70%, at least 75%, at least 80%, at least 85%, at least 90%, at least 95% or more sequence identity to the amino acid sequence selected from the group consisting of SEQ ID NOs: 259, 286-295, 393-395, and 472-485, wherein the polypeptide belongs to the same protein family as SEQ ID NOs: 259, 286-295, 393-395, and 472-485 and having an insect killing or inhibitory activity.

According to some embodiments of the invention, the polypeptide in (iii) comprises the domains characterized by InterPro accession numbers IPR011658, IPR003961 and IPR0137833.

According to some embodiments of the invention, the polypeptide is embedded in a phylogenetic tree selected from the group consisting of the phylogenetic trees depicted in FIG. 1A, FIG. 1B and FIG. 1C, as constructed by the MEGA7 software and the neighbor joining method using default parameters.

According to some embodiments of the invention, wherein the polypeptide in (i) is selected from the group consisting of SEQ ID NOs: 257, 284-285, 377-387 and 457-471, the polypeptide in (ii) is selected from the group consisting of SEQ ID NOs: 250, 296, 306-315 and 486-490, and wherein the polypeptide in (iii) is selected from the group consisting of SEQ ID NOs: 259, 286-295, 393-395, 472-485.

The term "isolated" refers to at least partially separated from the natural environment e.g., from a plant cell or from a bacterium cell.

The invention also encompasses fragments of the above described polypeptides and polypeptides having mutations, such as deletions, insertions or substitutions of one or more amino acids, either naturally occurring or man induced, either randomly or in a targeted fashion.

It should be noted that in some cases the polypeptide used by the method and/or the composition-of-matter of some embodiments of the invention can be modified as compared to the native protein exist in the bacterium. The protein can include a heterologous signal peptide (that is not naturally present in the protein sequence of the bacterium from which the polypeptide sequence was isolated); can lack (exclude) a native signal peptide (e.g., by removal of the native signal peptide of the protein sequence of the bacterium from which the polypeptide sequence was isolated); can include additional modifications for increasing activity of the polypeptide in vitro and/or in vivo; can include modifications which increase stability of the protein in vitro and/or in vivo; and/or can include additional tags to facilitate isolation of the protein (e.g., a recombinant polypeptide that is expressed from a polynucleotide sequence). For example, the modified polypeptide can include a signal peptide for expression in a host cell-of-interest and/or in a specific organelle or cellular localization within the host cells (e.g., plant cell or bacterial cell), or for increasing secretion of the polypeptide from the host cell. Exemplary non-limiting modifications are provided in Table 31 (for expression in *E. coli*) and in Table 32 (for expression in specific plant cells, such as *Arabidopsis*, Tomato, Soy and Maize).

In some embodiments, the modification is performed on a polynucleotide comprising the nucleic acid encoding the polypeptide of interest.

In some embodiments, when the original polypeptide sequence includes a signal peptide (also referred herein as a "native signal peptide", i.e., a signal peptide that is encoded by the same open reading frame as the polypeptide-of-interest) such a native signal peptide can be removed, and/or replaced with an exogenous signal peptide of interest (i.e., with a signal peptide or a transit peptide that is not naturally present within the same open reading frame of the polypeptide-of-interest).

It should be noted that a polypeptide that was modified by removal of a native signal peptide thereof is considered herein as a "derived polypeptide". Such a derived polypeptide includes the amino acid sequence of the mature polypeptide, without the native signal peptide of either a curated or an isolated natural polypeptide.

As used herein the term "curated polypeptide" refers to a predicted amino acid sequence of a gene not yet verified by cloning, which is obtained by assembly of genomic sequences, e.g., using propriety pipelines.

As used herein the term "natural polypeptide" refers to an amino acid sequence as determined from a cloning-verified DNA sequence of a gene encoding the polypeptide.

Various computer software can be used to identify presence of a signal peptide and its predicted cleavage site in a polypeptide, these include, but are not limited to, (i) the SignalP [(DTU Bioinformatics, Department of Bio and Health Informatics) e.g., as described in Nielsen Henrik 2017 ("Predicting Secretory Proteins with SignalP", In Kihara, D (ed): Protein Function Prediction. Methods in Molecular Biology vol. 1611 pp. 59-73, Springer 2017); Nielsen H, et al. "Identification of prokaryotic and eukaryotic signal peptides and prediction of their cleavage sites". Protein Eng. 1997a; 10:1-6; Nielsen H, et al. "A neural network method for identification of prokaryotic and eukaryotic signal peptides and prediction of their cleavage sites". Int J Neural Syst. 1997b; 8:581-599; Nielsen H, et al. 1998, "Prediction of signal peptides and signal anchors by a hidden Markov model", Proceedings of the Sixth International Conference on Intelligent Systems for Molecular Biology (ISMB 6) Menlo Park, Calif.: AAAI Press; pp. 122-130; Nielsen H, et al. "Machine learning approaches for the prediction of signal peptides and other protein sorting signals". Protein Eng. 1999; 12:3-9; Bendtsen J D, et al. 2004. "Improved prediction of signal peptides: SignalP 3.0". J Mol Biol. 340:783-795; Petersen T N, et al. "SignalP 4.0: discriminating signal peptides from transmembrane regions". Nat Methods. 2011; 8:785-786; each of which is fully incorporated herein by reference in its entirety); (ii) the TatP 1.0 Server (DTU Bioinformatics, Department of Bio and Health Informatics) as described in Jannick Dyrlev Bendtsen, et al., 2005 (BMC bioinformatics 2005 6: 167); (iii) the Phoblus tool [A combined transmembrane topology and signal peptide predictor (Stockholm Bioinformatics Centre); Kill L, et al., 2004. "A combined transmembrane topology and signal peptide prediction method", J Mol Biol. 2004 May 14; 338(5):1027-36]; (iv) the PSORTb version 3.0.2 (Yu N Y et al., 2010, "PSORTb 3.0: improved protein subcellular localization prediction with refined localization subcategories and predictive capabilities for all prokaryotes. "Bioinformatics. 2010; 26(13):1608-15); (v) the PrediSi tool (Hiller K, et al., 2004. "PrediSi: prediction of signal peptides and their cleavage positions". Nucleic Acids Res. 2004; 32:W375-W379); (vi) the Signal-3L tool (Shen H B, et al. 2007. "Signal-3L: A 3-layer approach for predicting signal peptides". Biochem Biophys Res Commun. 2007; 363:297-303); and (vii) the Phillus programs (Reynolds S M, et al. 2008. "Transmembrane topology and signal peptide prediction using dynamic bayesian networks". PLoS Comput Biol. 2008; 4:e1000213).

It should be noted that in some cases, following removal of a native (endogenous) signal peptide the coding sequence of a polypeptide can be adjusted by addition of at least one nucleic acid sequence to maintain the reading frame of the protein. For example, in case of signal peptide removal, the codon for the initiator methionine and in some cases of a subsequent artificial Glycine can be added to enable cloning and adequate translation.

Following is a non-limiting example of signal peptides and/or 5' UTR (untranslated region) which can be added to the polypeptide of some embodiments of the invention.

TABLE 2

| SEQ ID NO | Description of signal/transit peptide or 5'UTR sequences |
|---|---|
| 742 | Transit peptide to the chloroplast of Maize RuBisCo small subunit 2A protein (nucleotide) |
| 743 | Transit peptide to the chloroplast of Maize RuBisCo small subunit 2A protein (protein) |
| 744 | Apoplast Signal Peptide from Tobacco PR1a optimized for tomato and Arabidopsis (nucleotide) |
| 745 | Apoplast Signal Peptide from Tobacco PR1a (protein) |
| 746 | Vacuole Signal Peptide from Sweet potato sporamine optimized for tomato and Arabidopsis (nucleotide) |
| 747 | Vacuole Signal Peptide from Sweet potato sporamine (protein) |
| 748 | Tomato RuBisCO Signal Peptide optimized to Arabidopsis and tomato (nucleotide) |
| 749 | Tomato RuBisCO Signal Peptide (protein) |
| 750 | 5'UTR from Tomato Leucine aminopeptidase 2 |
| 751 | PelB signal peptide (nucleotide) |
| 752 | PelB signal peptide (protein) |

Table 2.

According to an aspect of some embodiments of the invention, there is provided an isolated polynucleotide encoding the polypeptide of some embodiments of the invention.

According to an aspect of some embodiments of the invention, there is provided an isolated polynucleotide comprising a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more (e.g., 100%) homologous or identical to an amino acid sequence selected from the group consisting of SEQ ID NOs: 249-495, 552-607, 632-655 and 656-697.

According to an aspect of some embodiments of the invention, there is provided an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more (e.g., 100%) identical to the amino acid sequence selected from the group consisting of SEQ ID NOs: 1-248, 496-551, 608-631.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence of a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within an organism of interest (e.g., a plant species, a bacterial species). Therefore, an optimized gene or nucleic acid sequence refers to a gene in which the nucleotide sequence of a native or naturally occurring gene has been modified in order to utilize statistically-preferred or statistically-favored codons within the organism of interest. The nucleotide sequence typically is examined at the DNA level and the coding region optimized for expression in the organism species of interest is determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn] 2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (kazusa(dot)or(dot)jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively affect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologues are evolutionary counterparts derived from a single ancestral gene in the last common ancestor of given two species (Koonin E V and Galperin M Y (Sequence—Evolution—Function: Computational Approaches in Comparative Genomics. Boston: Kluwer Academic; 2003. Chapter 2, Evolutionary Concept in Genetics and Genomics. Available from: ncbi(dot)nlm (dot)nih(dot)gov/books/NBK20255) and therefore have great likelihood of having the same function.

Identification of homologous sequences in bacterial species involves in the first stage blasting of the sequence-of-interest against any sequence database, such as the publicly available NCBI database which may be found at: ncbi (dot) nlm (dot) nih (dot) gov using local identity which is defined with a very permissive cutoff since it is only a filter for the second global alignment stage.

At the second stage, homologous sequences are defined based on global identity of at least 80% of the filtered results from the first stage to the sequence of interest. There are several algorithms for finding the optimal global alignment for protein or nucleotide sequences.

1. Between two proteins: EMBOSS-6.0.1 Needleman-Wunsch algorithm with the following parameters: gapopen=8 gapextend=2 Hypertext Transfer Protocol://emboss (dot)sourceforge(dot)net/apps/cvs/emboss/apps/needle(dot) html; A general method applicable to the search of similarities in the amino acid sequence of two proteins" Journal of Molecular Biology, 1970, pages 443-53, volume 48.

2. Between a nucleotide sequence to a protein sequence: GenCore 6.0 Smith-Waterman algorithm with the following parameters: model=frame+_p2n.model mode=qglobal Hypertext Transfer Protocol://www(dot)biocceleration(dot)com/Products(dot)html;

Homology (e.g., percent homology, sequence identity+ sequence similarity) can be determined using any homology comparison software computing a pairwise sequence alignment.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., an homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from biocceleration(dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cut-off—60% Identity on a span of 60% of the sequences lengths because it is used only as a filter for the global alignment stage. In this specific embodiment (when the local identity is used), the default filtering of the Blast package is not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between two proteins (following the blastp filter): EMBOSS-6.0.1 Needleman-Wunsch algorithm with the following modified parameters: gapopen=8 gapextend=2. The rest of the parameters are unchanged from the default options listed here:

Standard (Mandatory) Qualifiers:

[-asequence] sequence Sequence filename and optional format, or reference (input USA)

[-bsequence] seqall Sequence(s) filename and optional format, or reference (input USA)

-gapopen float [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)

-gapextend float [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)

[-outfile] align [*.needle] Output alignment file name
Additional (Optional) Qualifiers:
-datafile matrixf [EBLOSUM62 for protein, EDNAFULL for DNA]. This is the scoring matrix file used when comparing sequences. By default it is the file 'EBLOSUM62' (for proteins) or the file 'EDNAFULL' (for nucleic sequences). These files are found in the 'data' directory of the EMBOSS installation.
Advanced (Unprompted) Qualifiers:
-[no]brief boolean [Y] Brief identity and similarity
Associated Qualifiers:
"-asequence" associated qualifiers
-sbegin1 integer Start of the sequence to be used
-send1 integer End of the sequence to be used
-sreverse1 boolean Reverse (if DNA)
-sask boolean Ask for begin/end/reverse
-snucleotide1 boolean Sequence is nucleotide
-sprotein1 boolean Sequence is protein
-slower1 boolean Make lower case
-supper1 boolean Make upper case
-sformat1 string Input sequence format
-sdbname1 string Database name
-sid1 string Entryname
-ufo1 string UFO features
-fformat1 string Features format
-fopenfile1 string Features file name
"-bsequence" associated qualifiers
-sbegin2 integer Start of each sequence to be used
-send2 integer End of each sequence to be used
-sreverse2 boolean Reverse (if DNA)
-sask2 boolean Ask for begin/end/reverse
-snucleotide2 boolean Sequence is nucleotide
-sprotein2 boolean Sequence is protein
-slower2 boolean Make lower case
-supper2 boolean Make upper case
-sformat2 string Input sequence format
-sdbname2 string Database name
-sid2 string Entryname
-ufo2 string UFO features
-fformat2 string Features format
-fopenfile2 string Features file name
"-outfile" associated qualifiers
-aformat3 string Alignment format
-aextension3 string File name extension
-adirectory3 string Output directory
-aname3 string Base file name
-awidth3 integer Alignment width
-aaccshow3 boolean Show accession number in the header
-adesshow3 boolean Show description in the header
-ausashow3 boolean Show the full USA in the alignment
-aglobal3 boolean Show the full sequence in alignment
General Qualifiers:
-auto boolean Turn off prompts
-stdout boolean Write first file to standard output
-filter boolean Read first file from standard input, write first file to standard output
-options boolean Prompt for standard and additional values
-debug boolean Write debug output to program.dbg
-verbose boolean Report some/full command line options
-help boolean Report command line options. More information on associated and general qualifiers can be found with -help -verbose
-warning boolean Report warnings
-error boolean Report errors
-fatal boolean Report fatal errors
-die boolean Report dying program messages 2. Between a protein sequence and a nucleotide sequence (following the tblastn filter):

GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options:

Usage:
om -model=<model_fname>[-q=]query [-db=]database [options]
-model=<model_fname> Specifies the model that you want to run. All models supplied by Compugen are located in the directory $CGNROOT/models/.
Valid Command Line Parameters:
-dev=<dev_name> Selects the device to be used by the application.
Valid devices are:
bic—Bioccelerator (valid for SW, XSW, FRAME_N2P, and FRAME_P2N models).
xlg—BioXL/G (valid for all models except XSW).
xlp—BioXLIP (valid for SW, FRAME+_N2P, and FRAME_P2N models).
xlh—BioXLJH (valid for SW, FRAME+_N2P, and FRAME_P2N models).
soft—Software device (for all models).
-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.
-db=<database name> Chooses the database set. The database set can be a sequence file or a database reference. The database format is detected automatically. However, you may specify a format using -dfmt parameter.
-qacc Add this parameter to the command line if you specify query using accession numbers.
-dace Add this parameter to the command line if you specify a database using accession numbers.
-dfmt/-qfmt=<format_type> Chooses the database/query format type. Possible formats are:
fasta—fasta with seq type auto-detected.
fastap—fasta protein seq.
fastan—fasta nucleic seq.
gcg—gcg format, type is auto-detected.
gcg9seq—gcg9 format, type is auto-detected.
gcg9seqp—gcg9 format protein seq.
gcg9seqn—gcg9 format nucleic seq.
nbrf—nbrf seq, type is auto-detected.
nbrfp—nbrf protein seq.
nbrfn—nbrf nucleic seq.
embl—embl and swissprot format.
genbank—genbank format (nucleic).
blast—blast format.

nbrf_gcg—nbrf-gcg seq, type is auto-detected.
nbrf_gcgp—nbrf-gcg protein seq.
nbrf_gcgn—nbrf-gcg nucleic seq.
raw—raw ascii sequence, type is auto-detected.
rawp—raw ascii protein sequence.
rawn—raw ascii nucleic sequence.
pir—pir codata format, type is auto-detected.
profile—gcg profile (valid only for -qfint
in SW, XSW, FRAME_P2N, and FRAME+_P2N).
-out=<out_fname> The name of the output file.
-suffix=<name> The output file name suffix.
-gapop=<n> Gap open penalty. This parameter is not valid for FRAME+. For FrameSearch the default is 12.0. For other searches the default is 10.0.
-gapext=<n> Gap extend penalty. This parameter is not valid for FRAME+. For FrameSearch the default is 4.0. For other models: the default for protein searches is 0.05, and the default for nucleic searches is 1.0.
-qgapop=<n> The penalty for opening a gap in the query sequence. The default is 10.0. Valid for XSW.
-qgapext=<n> The penalty for extending a gap in the query sequence. The default is 0.05. Valid for XSW.
-start=<n> The position in the query sequence to begin the search.
-end=<n> The position in the query sequence to stop the search.
-qtrans Performs a translated search, relevant for a nucleic query against a protein database. The nucleic query is translated to six reading frames and a result is given for each frame.
  Valid for SW and XSW.
-dtrans Performs a translated search, relevant for a protein query against a DNA database. Each database entry is translated to six reading frames and a result is given for each frame.
  Valid for SW and XSW.
Note: "-qtrans" and "-dtrans" options are mutually exclusive.
-matrix=<matrix_file> Specifies the comparison matrix to be used in the search. The matrix must be in the BLAST format. If the matrix file is not located in $CGNROOT/tables/matrix, specify the full path as the value of the -matrix parameter.
-trans=<transtab_name> Translation table. The default location for the table is $CGNROOT/tables/trans.
-onestrand Restricts the search to just the top strand of the query/database nucleic sequence.
-list=<n> The maximum size of the output hit list. The default is 50.
-docalign=<n> The number of documentation lines preceding each alignment. The default is 10.
-thr_score=<score_name> The score that places limits on the display of results. Scores that are smaller than -thr_min value or larger than -thr_max value are not shown. Valid options are: quality.
  zscore.
  escore.
-thr_max=<n> The score upper threshold. Results that are larger than -thr_max value are not shown.
-thr_min=<n> The score lower threshold. Results that are lower than -thr_min value are not shown.
-align=<n> The number of alignments reported in the output file.
-noalign Do not display alignment.
Note: "-align" and "-noalign" parameters are mutually exclusive.
-outfmt=<format_name> Specifies the output format type.

The default format is PFS. Possible values are:
  PFS—PFS text format
  FASTA—FASTA text format
  BLAST—BLAST text format
-nonorm Do not perform score normalization.
-norm=<norm_name> Specifies the normalization method. Valid options are:
  log—logarithm normalization.
  std—standard normalization.
  stat—Pearson statistical method.
Note: "-nonorm" and "-norm" parameters cannot be used together.
Note: Parameters -xgapop, -xgapext, -fgapop, -fgapext, -ygapop, -ygapext, -delop, and -delext apply only to FRAME+.
-xgapop=<n> The penalty for opening a gap when inserting a codon (triplet). The default is 12.0.
-xgapext=<n> The penalty for extending a gap when inserting a codon (triplet). The default is 4.0.
-ygapop=<n> The penalty for opening a gap when deleting an amino acid. The default is 12.0.
-ygapext=<n> The penalty for extending a gap when deleting an amino acid. The default is 4.0.
-fgapop=<n> The penalty for opening a gap when inserting a DNA base. The default is 6.0.
-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host_name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.
Note:"-batch" and "-wait" parameters are mutually exclusive.
-version Prints the software version number.
-help Displays this help message. To get more specific help type:
  "om -model=<model_fname>-help".
According to some embodiments the homology is a local homology or a local identity.

Local alignments tools include, but are not limited to the BlastP, BlastN, BlastX or TBLASTN software of the National Center of Biotechnology Information (NCBI), FASTA, and the Smith-Waterman algorithm.

A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases EST and HTGs, respectively.

Default parameters for blastp include: Max target sequences: 100; Expected threshold: $e^{-5}$; Word size: 3; Max matches in a query range: 0; Scoring parameters: Matrix—BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

According to an aspect of some embodiments of the invention, there is provided a nucleic acid construct comprising the isolated polynucleotide of some embodiments of the invention and a promoter operably linked thereto, wherein the promoter is capable of directing transcription of the nucleic acid sequence in a host cell.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed. A promoter can be an endogenous or a heterologous promoter with respect to the gene (polynucleotide) controlled thereby.

A "heterologous polynucleotide" as used herein refers to a polynucleotide from one species which is expressed in a cell of another species.

For example, when the isolated polynucleotide (e.g. derived from a bacterial cell) is expressed in a plant cell then the isolated bacterial polynucleotide is heterologous to the plant host cell.

Additionally or alternatively, when the isolated polynucleotide from a certain bacterial cell (a certain bacterial isolate) is expressed in another bacterial organism than the organism of the original bacterial isolate, then the isolated polynucleotide is heterologous to the bacterial host cell.

As used herein the phrase "heterologous promoter" refers to a promoter from a different species or from the same species but from a different gene locus as of the isolated polynucleotide sequence. For example, the isolated polynucleotide can be expressed under a different promoter than the original (native) promoter under which regulation the isolated polynucleotide is expressed in the original bacterial isolate cell. In this case the polynucleotide is heterologous to the promoter. The promoter can be from the same organism or from a different organism (e.g., *E. coli*, or *vibrio*).

According to some embodiments of the invention, the promoter is heterologous to the isolated polynucleotide and/or to the host cell.

According to some embodiments of the invention, the promoter is heterologous to the isolated polynucleotide.

According to some embodiments of the invention, the promoter is heterologous to the host cell.

Any suitable promoter sequence can be used by the nucleic acid construct of some embodiments of the invention. For example, for expression in a plant cell the promoter is a plant promoter, preferably a constitutive promoter, a tissue-specific, an abiotic stress-inducible promoter, or a chemical induced promoter. For expression in a bacterial cell the promoter is a bacterial promoter, preferably a constitutive promoter, a stage-specific promoter or an inducible promoter.

According to some embodiments of the invention, the promoter is a plant promoter, which is suitable for expression of the exogenous polynucleotide in a plant cell.

Suitable promoters for expression in any plant species include, but are not limited to, Wheat SPA promoter (SEQ ID NO: 698; Albanietal, Plant Cell, 9: 171-184, 1997, which is fully incorporated herein by reference), wheat LMW (SEQ ID NO: 699 (longer LMW promoter), and SEQ ID NO: 700 (LMW promoter) and HMW glutenin-1 (SEQ ID NO: 701 (Wheat HMW glutenin-1 longer promoter); and SEQ ID NO:702 (Wheat HMW glutenin-1 Promoter); Thomas and Flavell, The Plant Cell 2:1171-1180; Furtado et al., 2009 Plant Biotechnology Journal 7:240-253, each of which is fully incorporated herein by reference), wheat alpha, beta and gamma gliadins [e.g., SEQ ID NO: 703 (wheat alpha gliadin, B genome, promoter); SEQ ID NO:704 (wheat gamma gliadin promoter); EMBO 3:1409-15, 1984, which is fully incorporated herein by reference], wheat TdPR60 [SEQ ID NO: 705 (wheat TdPR60 longer promoter) or SEQ ID NO:706 (wheat TdPR60 promoter); Kovalchuk et al., Plant Mol Biol 71:81-98, 2009, which is fully incorporated herein by reference], maize Ub1 Promoter [cultivar Nongda 105 (SEQ ID NO: 707); GenBank: DQ141598.1; Taylor et al., Plant Cell Rep 1993 12: 491-495, which is fully incorporated herein by reference; and cultivar B73 (SEQ ID NO: 708); Christensen, A H, et al. Plant Mol. Biol. 18 (4), 675-689 (1992), which is fully incorporated herein by reference]; rice actin 1 (SEQ ID NO: 709; Mc Elroy et al. 1990, The Plant Cell, Vol. 2, 163-171, which is fully incorporated herein by reference), rice GOS2 [SEQ ID NO: 710 (rice GOS2 longer promoter) and SEQ ID NO:711 (rice GOS2 Promoter); De Pater et al. Plant J. 1992; 2: 837-44, which is fully incorporated herein by reference], arabidopsis Pho1 [SEQ ID NO: 712 (arabidopsis Pho1 Promoter); Hamburger et al., Plant Cell. 2002; 14: 889-902, which is fully incorporated herein by reference], ExpansinB promoters, e.g., rice ExpB5 [SEQ ID NO:713 (rice ExpB5 longer promoter) and SEQ ID NO: 714 (rice ExpB5 promoter)] and Barley ExpB1 [SEQ ID NO:715 (barley ExpB1 Promoter), Won et al. Mol Cells. 2010; 30:369-76, which is fully incorporated herein by reference], barley SS2 (sucrose synthase 2) [(SEQ ID NO: 716), Guerin and Carbonero, Plant Physiology May 1997 vol. 114 no. 1 55-62, which is fully incorporated herein by reference], and rice PG5a [SEQ ID NO: 717, U.S. Pat. No. 7,700,835, Nakase et al., Plant Mol Biol. 32:621-30, 1996, each of which is fully incorporated herein by reference].

Suitable constitutive promoters include, for example, CaMV 35S promoter [SEQ ID NO: 718 (CaMV 35S (pQXNc) Promoter); SEQ ID NO: 719 (PJJ 35S from Brachypodium); SEQ ID NO:720 (CaMV 35S (OLD) Promoter) (Odell et al., Nature 313:810-812, 1985)], *Arabidopsis* At6669 promoter (SEQ ID NO: 721 (*Arabidopsis* At6669 (OLD) Promoter); see PCT Publication No. WO04081173A2 or the new At6669 promoter (SEQ ID NO: 722 (*Arabidopsis* At6669 (NEW) Promoter)); maize Ub1 Promoter [cultivar Nongda 105 (SEQ ID NO: 707); GenBank: DQ141598.1; Taylor et al., Plant Cell Rep 1993 12: 491-495, which is fully incorporated herein by reference; and cultivar B73 (SEQ ID NO: 708); Christensen, A H, et al. Plant Mol. Biol. 18 (4), 675-689 (1992), which is fully incorporated herein by reference]; rice actin 1 (SEQ ID NO: 709, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); rice GOS2 [SEQ ID NO: 710 (rice GOS2 longer Promoter) and SEQ ID NO: 711 (rice GOS2 Promoter), de Pater et al, Plant J November; 2(6):837-44, 1992]; Brachypodium RBCS promoter (SEQ ID NO: 723); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5.608,144; 5,604,121; 5.569,597: 5.466,785; 5,399,680; 5,268,463; and 5,608,142.

Suitable tissue-specific promoters include, but not limited to, leaf-specific promoters [e.g., AT5G06690 (Thioredoxin) (high expression, SEQ ID NO: 724), AT5G61520 (AtSTP3) (low expression, SEQ ID NO: 725) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al, Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO: 726 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, el al., Plant Mol. Biol. 14: 633, 1990), rice PG5a (SEQ ID NO: 717; U.S. Pat. No. 7,700, 835), early seed development *Arabidopsis* BAN (AT1G61720) (SEQ ID NO: 727, US 2009/0031450 A1), late seed development *Arabidopsis* ABI3 (AT3G24650) (SEQ ID NO: 728 (*Arabidopsis* ABI3 (AT3G24650) longer Promoter) or SEQ ID NO:729 (*Arabidopsis* ABI3 (AT3G24650) Promoter)) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143).323-32 1990), napA (Stalberg, et al, Planta 199: 515-519, 1996), Wheat SPA (SEQ ID NO: 698; Albanietal, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 699 (Wheat LMW Longer Promoter), and SEQ ID NO: 700 (Wheat LMW Promoter) and HMW glutenin-1 [(SEQ ID NO: 701 (Wheat HMW glutenin-1 longer Promoter)); and SEQ ID NO:702 (Wheat HMW glutenin-1 Promoter), Thomas and Flavell, The Plant Cell 2:1171-1180, 1990; Mol Gen Genet 216:81-90, 1989; NAR 17:461-2), wheat alpha, beta and gamma gliadins (SEQ ID NO: 703 (wheat alpha gliadin (B genome) promoter); SEQ ID NO:704 (wheat gamma gliadin promoter); EMBO 3:1409-15, 1984), Barley Itr1 promoter, barley BI, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (SEQ ID NO: 716 (Barley SS2 Promoter); Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice -globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al., Mol. Gen Genet. 217:240-245; 1989), *Arabidopsis apetala*—3 (Tilly et al., Development. 125:1647-57, 1998), *Arabidopsis* APETALA 1 (AT1G69120, API) (SEQ ID NO: 730 (*Arabidopsis* (AT1G69120) APETALA 1)) (Hempel et al., Development 124:3845-3853, 1997)], and root promoters [e.g., the ROOTP promoter [SEQ ID NO: 731]; rice ExpB5 [SEQ ID NO: 714 (rice ExpB5 Promoter); or SEQ ID NO: 713 (rice ExpB5 longer Promoter)] and barley ExpB1 promoters (SEQ ID NO: 715) (Won et al. Mol. Cells 30: 369-376, 2010); arabidopsis ATTPS-CIN (AT3G25820) promoter (SEQ ID NO: 732; Chen et al., Plant Phys 135:1956-66, 2004); arabidopsis Pho1 promoter (SEQ ID NO: 712, Hamburger et al., Plant Cell. 14: 889-902, 2002), which is also slightly induced by stress]. Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187, 267).

According to some embodiments of the invention, the promoter originates from bacteria or from a bacteriophage, and is suitable for expression of the exogenous polynucleotide in a bacterial cell.

Non-limiting examples of promoter sequences which can be used for expression in a bacterial cell include T7 promoter, Tac promoter, lac promoter, araBAD promoter, lacUV5 promoter, tac (hybrid), trc (hybrid), trp, phoA, recA, proU, cst-1, tetA, cadA, nar, PL, cspA, sp6, T7-lac operator, T3-lac operator, T5-lac operator, T4 gene 32, nprM-lac operator, VHb, and protein A promoter.

According to some embodiments of the invention, the promoter is suitable for expression in an insect cell. Such promoters can originate from various viruses such as Baculovirus, or flies such as *Drosophila*.

Non-limiting examples of promoters which are suitable for expression in an insect cell include polyhedrin, p10, IE-0, PCNA, OplE2, OplE1, Metallothionein and Actin SC promoters.

According to some embodiments of the invention, the biologically pure bacterial isolate, and/or the lysate or whole cell broth and/or the isolated polypeptide and/or the isolated polynucleotide and/or the nucleic acid construct and/or the composition-of-matter comprising same is capable of killing or inhibiting the development of an insect.

As used herein and in the claims section below, the phrase "capable of killing . . . an insect" refers to an effective amount of the agent of some embodiments of the invention (e.g., the biologically pure bacterial isolate of some embodiments of the invention, the lysate of some embodiments of the invention, the composition-of-matter of some embodiments of the invention, the polypeptide of some embodiments of the invention, the polynucleotide of some embodiments of the invention, and/or the nucleic acid construct of some embodiments of the invention) which is capable of killing at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, at least about 99%, or 100% of a population of the insect as compared to the population of an insect of the same species in the absence of the effective amount of the agent when grown under the same (e.g., identical) growth conditions; and/or when compared to the initial population of the insect prior to being contacted with the agent of some embodiments of the invention. Cell killing is determined by methods known in the art e.g., using various stains such as propidium iodide (PI), 4',6-Diamidine-2'-phenylindole dihydrochloride (DAPI), and/or by monitoring DNA fragmentation (e.g., by staining a gel with ethidium bromide) and the like.

Methods of qualifying insect killing activity of an agent are known in the art (e.g., Macintosh, Susan C., et al. "Specificity and efficacy of purified *Bacillus thuringiensis* proteins against agronomically important insects." Journal of invertebrate pathology 56.2 (1990): 258-266; O'Callahan M., et al. Bioassay of bacterial entomopathogens against insect larvae. Lacey, Lawrence A., ed. Manual of techniques in invertebrate pathology. Academic Press, 2012. Chapter IV p:101-127; each of which is fully incorporated herein by reference with its entirety), and are further described and exemplified hereinbelow in Examples 7 and 9 of the Examples section which follows. In addition, $IC_{50}$ values can be determined to qualify effective concentration of the agent resulting in killing of at least 50% of the insect population.

Following is a non-limiting description of $IC_{50}$ determination of an agent (e.g., an isolated polypeptide or a bacterial whole cell broth or lysate) which is contacted with the insect. Briefly, protein samples are applied topically on the insect artificial diet (e.g., 100 μl in each of a 96-well microtiter plate). The agent (e.g., the protein sample or the bacterial lysate sample) is serially diluted with reduction of 50% in concentration at each step prior to applying to the wells, and negative and positive controls are prepared. A typical dilution series would be 1 mg/ml, 0.5 mg/ml, 0.25 mg/ml, 0.125 mg/ml, and 0.062 mg/ml. In cases where bacterial lysates are used as the agent sample, the negative control is a bacterial lysate of a strain with an empty plasmid vector prepared at the same concentration as the highest lysate sample of the protein of interest. Typically, 15 μl of sample are applied to each well of the diet. After application, the plates are held for 30-45 minutes allowing absorption/drying of samples. Plates are then infested with the insect species of interest using e.g., a fine camel hair brush (e.g., when the lepidopteran insects are used) or by transferring a mass infest of an average 5 insects/well (e.g., in case the Western corn rootworm are used). Following infestation, the plates are sealed with a microtiter plate mylar seal membrane which is then punctured above each well with a fine insect pin. The plates are then placed at the appropriate temperature incubator and held for 96 hours prior to scoring for response. Insect response can be graded as normal (no response, "0"), stunting (moderate reduction in insect mass compared to negative controls, "1"), severe stunting (less than 20% the size of negative controls, "2"), or death ("3").

As used herein and in the claims section below, the phrases "inhibitory activity" and/or "inhibiting the development of an insect", which are interchangeably used herein, refer to an activity which results in reducing the size and/or mass (e.g., stunting) of the insect as compared to the size and/or mass of an insect of the same species in the absence of the effective amount of the agent under the same (e.g., identical) growth conditions; and/or when compared to the size and/or mass of the insect prior to being contacted with the agent of some embodiments of the invention.

It should be noted that inhibition of the development of the insect can be quantified by weighing the insect mass before and after being contacted with the agent of some embodiments of the invention, and/or by measuring the size (e.g., length and/or width and/or height) of the insect before and after being contacted with the agent of some embodiments of the invention, and/or by comparing the size and/or mass of the same species of insect when grown in the presence of the agent of some embodiments of the invention to the size and/or mass, respectively, of the same species of insect when grown in the absence of the agent of some embodiments of the invention under the same (e.g., identical) growth conditions.

According to some embodiments of the invention, the effective amount of the agent of some embodiments of the invention (e.g., the biologically pure bacterial isolate of some embodiments of the invention, the lysate or whole cell broth of some embodiments of the invention, the composition of some embodiments of the invention, the polypeptide of some embodiments of the invention, the polynucleotide of some embodiments of the invention, and/or the nucleic acid construct of some embodiments of the invention) is capable of inhibiting the development of the insect by at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, at least about 99%, or 100% as compared to the development of an insect of the same species in the absence of the effective amount of the agent under the same (e.g., identical) growth conditions; and/or as compared to the development of the insect prior to being contacted with the agent of some embodiments of the invention.

Insect pests include insects selected from the orders Lepidoptera, Coleoptera, Diptera, Hemiptera, Hymenoptera, Mallophaga, Homoptera, Orthroptera, Thysanoptera, Dermaptera, Isoptera, Anoplura, Siphonaptera, Trichoptera and the like.

According to some embodiments of the invention, the insect pests include insects from the orders of Lepidoptera, Coleoptera, and Hemiptera.

The order Lepidoptera includes several families such as Papilionidae, Pieridae, Lycaenidae, Nymphalidae, Danaidae, Satyridae, Hesperiidae, Sphingidae, Saturniidae, Geometridae, Arctiidae, Noctuidae, Lymantriidae, Sesiidae, and Tineidae.

Non-limiting examples of insects of the order Lepidoptera include, but are not limited to, armyworms, cutworms, loopers, and heliothines in the Family Noctuidae, e.g., Fall armyworm (*Spodoptera frugiperda*), Beet armyworm (*Spodoptera exigua*), Black armyworm (*Spodoptera exempta*), Southern armyworm (*Spodoptera eridania*), bertha armyworm (*Mamestra configurata*), black cutworm (*Agrotis ipsilon*), cabbage looper (*Trichoplusia ni*), soybean looper (*Pseudoplusia includens*), velvetbean caterpillar (*Anticarsia gemmatalis*), green cloverworm (*Hypena scabra*), tobacco budworm (*Heliothis virescens*), granulate cutworm (*Agrotis subterranea*), armyworm (*Pseudaletia unipuncta*), western cutworm (*Agrotis orthogonia*); borers, casebearers, webworms, coneworms, cabbageworms and skeletonizers from the Family Pyralidae, e.g., European corn borer (*Ostrinia nubilalis*), navel orangeworm (*Amyelois transitella*), corn root webworm (*Crambus caliginosellus*), sod webworm (*Herpetogramma licarsisalis*), sunflower moth (*Homoeosoma electellum*), lesser cornstalk borer (*Elasmopalpus lignosellus*); leafrollers, budworms, seed worms, and fruit worms in the Family Tortricidae, e.g., codling moth (*Cydia pomonella*), grape berry moth (*Endopiza viteana*), oriental fruit moth (*Grapholita molesta*), sunflower bud moth (*Suleima helianthana*); and many other economically important Lepidoptera, e.g., diamondback moth (*Plutella xylostella*), pink bollworm (*Pectinophora gossypiella*), and gypsy moth (*Lymantria dispar*). Other insect pests of order Lepidoptera include, e.g., cotton leaf worm (*Alabama argillacea*), fruit tree leaf roller (*Archips argyrospila*), European leafroller (*Archips rosana*) and other *Archips* species, (*Chilo suppressalis*, Asiatic rice borer, or rice stem borer), rice leaf roller (*Cnaphalocrocis medinalis*), corn root webworm (*Crambus caliginosellus*), bluegrass webworm (*Crambus leterrellus*), southwestern corn borer (*Diatraea grandiosella*), sugarcane borer (*Diatraea saccharalis*), spiny bollworm (*Earias insulana*), spotted bollworm (*Earias vittella*), American bollworm (*Helicoverpa armigera*), corn earworm (*Helicoverpa zea*, also known as soybean podworm and cotton bollworm), tobacco budworm (*Heliothis virescens*), sod webworm (*Herpetogramma licarsisalis*), Western bean cutworm (*Striacosta albicosta*), European grape vine moth (*Lobesia botrana*), citrus leafminer (*Phyllocnistis citrella*), large white butterfly (*Pieris brassicae*), small white butterfly (*Pieris rapae*, also known as imported cabbageworm), beet armyworm (*Spodoptera exigua*), tobacco cutworm (*Spodoptera litura*, also known as cluster caterpillar), and tomato leafminer (*Tuta absoluta*).

According to some embodiments of the invention the insect is of the genera *Spodoptera, Helicoverpa, Chrysodeixis, Trichoplusia, Plutella, Ostrinia, Agrotis*. Examples include but are not limited to the species *Spodoptera exigua, Spodoptera littoralis* and *Spodoptera frugiperda, Helicoverpa zea* and *Helicoverpa armigera, Chrysodeixis includens, Chrysodeixis celebensis, Chrysodeixis eriosoma, Chrysodeixis argitifera, Chrysodeixis acuta illuminata, Chrysodeixis minutus* and *Chrysodeixis chalcites, Trichoplusia ni, Plutella xylostella, Ostrinia nubilalis, Agrotis ipsilon*.

The order Coleoptera includes the suborders *Adephaga* and *Polyphaga*. Suborder *Adephaga* includes the superfamilies Caraboidea and Gyrinoidea, while suborder *Polyphaga* includes the superfamilies Hydrophiloidea, Staphylinoidea, Cantharoidea, Cleroidea, Elateroidea, Dascilloidea, Dryopoidea, Byrrhoidea, Cucujoidea, Meloidea, Mordelloidea, Tenebrionoidea, Bostrichoidea, Scarabaeoidea, Cerambycoidea, Chrysomeloidea, and Curculionoidea. Superfamily Caraboidea includes the families Cicindelidae, Carabidae, and Dytiscidae. Superfamily Gyrinoidea includes the family Gyrinidae. Superfamily Hydrophiloidea includes the family Hydrophilidae. Superfamily Staphylinoidea includes the families Silphidae and Staphylinidae. Superfamily Cantharoidea includes the families Cantharidae and Lampyridae. Superfamily Cleroidea includes the families Cleridae and Dermestidae. Superfamily Elateroidea includes the families Elateridae and Buprestidae. Superfamily Cucujoidea includes the family Coccinellidae. Superfamily Meloidea includes the family Meloidae. Superfamily Tenebrionoidea includes the family Tenebrionidae. Superfamily Scarabaeoidea includes the families Passalidae and Scarabaeidae. Superfamily Cerambycoidea includes the family Cerambycidae. Superfamily Chrysomeloidea includes the family Chrysomelidae. Superfamily Curculionoidea includes the families Curculionidae and Scolytidae; Superfamily Chrysomeloidea includes the family Chrysomelidae. The genus *Diabrotica* and the species Western corn rootworm (*Diabrotica virgifera virgifera*) are included within the family Chrysomelidae.

According to some embodiments of the invention the insect is of the genus *Diabrotica*. Examples include, but are not limited to *Diabrotica speciosa, Diabrotica barberi, Diabrotica balteata, Diabrotica undecimpunctata*, and *Diabrotica virgifera*.

The order Diptera includes the Suborders Nematocera, Brachycera, and Cyclorrhapha. Suborder Nematocera includes the families Tipulidae, Psychodidae, Culicidae, Ceratopogonidae, Chironomidae, Simuliidae, Bibionidae, and Cecidomyiidae. Suborder Brachycera includes the families Stratiomyidae, Tabanidae, Therevidae, Asilidae, Mydidae, Bombyliidae, and Dolichopodidae. Suborder Cyclorrhapha includes the Divisions Aschiza and Aschiza. Division Aschiza includes the families Phoridae, Syrphidae, and Conopidae. Division Aschiza includes the Sections Acalyptratae and Calyptratae. Section Acalyptratae includes the families Otitidae, Tephritidae, Agromyzidae, and Drosophilidae. Section Calyptratae includes the families Hippoboscidae, Oestridae, Tachinidae, Anthomyiidae, Muscidae, Calliphoridae, and Sarcophagidae.

The order Hemiptera include, but is not limited to: *Acrosternum hilare* Say (green stink bug); *Anasa tristis* De Geer (squash bug); *Blissus leucopterus leucopterus* Say (chinch bug); *Corythuca gossypii* Fabricius (cotton lace bug); *Cyrtopeltis modesta* Distant (tomato bug); *Dysdercus suturellus* Herrich-Schaffer (cotton stainer); *Euschistus servus* Say (brown stink bug); *E. variolarius* Palisot de Beauvois (one-spotted stink bug); *Graptostethus* spp. (complex of seed bugs); *Leptoglossus corculus* Say (leaf-footed pine seed bug); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milkweed bug); *Pseudatomoscelis seriatus* Reuter (cotton fleahopper); *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Adelphocoris rapidus* Say (rapid plant bug); *Poecilocapsus lineatus* Fabricius (four-lined plant bug); *Nysius ericae* Schilling (false chinch bug); *Nysius raphanus* Howard (false chinch bug); *Eurygaster* spp.; *Coreidae* spp.; *Pyrrhocoridae* spp.; *Tinidae* spp.; *Blostomatidae* spp.; *Reduviidae* spp.; *Cimicidae* spp; and Green Peach Aphids (*Myzus persicae*).

According to some embodiments of the invention the insect is of the genera *Lygus, Myzus, Nezara* and *Halyomorpha*. Examples include but are not limited to *Lygus* hesperus and *Lygus lineolatus, Myzus persicae* and *Nezara viridula* and *Halyomorpha halys*.

As mentioned, the insects are pests of major crops, such as Maize, Sorghum, Wheat, Sunflower, Cotton, Rice, Soybean, Barley and Oil Seed Rape. Examples of insects for the various crops include, but are not limited to, insects of Maize: *Ostrinia nubilalis*, European corn borer; *Agrotis ipsilon*, black cutworm; *Helicoverpa zea*, corn earworm; *Spodoptera frugiperda*, fall armyworm; *Diatraea grandiosella*, southwestern corn borer; *Elasmopalpus lignosellus*, lesser cornstalk borer, *Diatraea saccharalis*, sugarcane borer; *Diabrotica virgifera*, western corn rootworm; *Diabrotica longicornis barberi*, northern corn rootworm; *Diabrotica undecimpunctata howardi*, southern corn rootworm; *Melanotus* spp., wireworms; *Cyclocephala borealis*, northern masked chafer (white grub); *Cyclocephala immaculata*, southern masked chafer (white grub); *Popillia japonica*, Japanese beetle; *Chaetocnema pulicaria*, corn flea beetle; *Sphenophorus maidis*, maize billbug; *Rhopalosiphum maidis*, corn leaf aphid; *Anuraphis maidiradicis*, corn root aphid; *Blissus leucopterus leucopterus*, chinch bug; *Melanoplus femurrubrum*, redlegged grasshopper; *Melanoplus sanguinipes*, migratory grasshopper; *Hylemya platura*, seedcorn maggot; *Agromyza parvicornis*, corn blot leafminer; *Anaphothrips obscrurus*, grass thrips; *Solenopsis milesta*, thief ant; *Tetranychus urticae*, twospotted spider mite; insects of Sorghum: *Chilo partellus*, sorghum borer, *Spodoptera frugiperda*, fall armyworm; *Helicoverpa zea*, corn earworm; *Elasmopalpus lignosellus*, lesser cornstalk borer; *Feltia subterranea*, granulate cutworm; *Phyllophaga crinita*, white grub; *Eleodes, Conoderus*, and *Aeolus* spp., wireworms; *Oulema melanopus*, cereal leaf beetle; *Chaetocnema pulicaria*, corn flea beetle; *Sphenophorus maidis*, maize billbug; *Rhopalosiphum maidis*; corn leaf aphid; Siphaflava, yellow sugarcane aphid; *Blissus leucopterus leucopterus*, chinch bug; *Contarinia sorghicola*, sorghum midge; *Tetranychus cinnabarinus*, carmine spider mite; *Tetranychus urticae*, twospotted spider mite; insects of Wheat: *Pseudaletia unipunctata*, army worm; *Spodoptera frugiperda*, fall armyworm; *Elasmopalpus lignosellus*, lesser cornstalk borer; *Agrotis orthogonia*, western cutworm; *Elasmopalpus lignosellus*, lesser cornstalk borer, *Oulema melanopus*, cereal leaf beetle; *Hypera punctata*, clover leaf weevil; *Diabrotica undecimpunctata howardi*, southern corn rootworm; Russian wheat aphid; *Schizaphis graminum*, greenbug, *Macrosiphum avenae*, English grain aphid; *Melanoplus femurrubrum*, redlegged grasshopper; *Melanoplus diferentialis*, differential grasshopper, *Melanoplus sanguinipes*, migratory grasshopper; *Mayetiola destructor*, Hessian fly; *Sitodiplosis mosellana*, wheat midge; *Meromyza americana*, wheat stem maggot; *Hylemya coarctata*, wheat bulb fly; *Frankliniella fusca*, tobacco thrips; *Cephus cinctus*, wheat stem sawfly; *Aceria tulipae*, wheat curl mite; insects of Sunflower: *Suleima helianthana*, sunflower bud moth; *Homoeosoma electellum*, sunflower moth; *Zygogramma exclamationis*, sunflower beetle; *Bothyrus gibbosus*, carrot beetle; *Neolasioptera murtfeldtiana*, sunflower seed midge; insects of Cotton: *Heliothis virescens*, cotton budworm; *Helicoverpa zea*, cotton bollworm; *Spodoptera exigua*, beet armyworm; *Pectinophora gossypiella*, pink bollworm; *Anthonomus grandis*, boll weevil; *Aphis gossypii*, cotton aphid; *Pseudatomoscelis seriatus*, cotton fleahopper, *Trialeurodes abutilonea*, bandedwinged whitefly; *Lygus lineolaris*, tarnished plant bug; *Melanoplus femurrubrum*, redlegged grasshopper; *Melanoplus diferentialis*, differential grasshopper, *Thrips tabaci*, onion thrips; *Franklinkiella fusca*, tobacco thrips; *Tetranychus cinnabarinus*, carmine spider mite; *Tetranychus urticae*, twospotted spider mite; insects of Rice: *Diatraea saccharalis*, sugarcane borer; *Spodoptera frugiperda*, fall armyworm; *Helicoverpa zea*, corn earworm; *Colaspis brunnea*, grape colaspis; *Lissorhoptrus oryzophilus*, rice water weevil; *Sitophilus oryzae*, rice weevil; *Nephotettix nigropictus*, rice leafhopper, *Blissus leucopterus leucopterus*, chinch bug; *Acrosternum hilare*, green stink bug; insects of Soybean: *Pseudoplusia includens*, soybean looper, *Anticarsia gemmatalis*, velvetbean caterpillar; *Plathypena scabra*, green cloverworm; *Ostrinia nubilalis*, European corn borer; *Agrotis ipsilon*, black cutworm; *Spodoptera exigua*, beet armyworm; *Heliothis virescens*, cotton budworm; *Helicoverpa zea*, cotton bollworm; *Epilachna varivestis*, Mexican bean beetle; *Myzus persicae*, green peach aphid; *Empoasca fabae*, potato leafhopper, *Acrosternum hilare*, green stink bug; *Melanoplus femurrubrum*, redlegged grasshopper; *Melanoplus diferentialis*, differential grasshopper; *Hylemya platura*, seedcorn maggot; *Sericothrips variabilis*, soybean thrips; *Thrips tabaci*, onion thrips; *Tetranychus turkestani*, strawberry spider mite; *Tetranychus urticae*, twospotted spider mite; insects of Barley. *Ostrinia nubilalis*, European corn borer; *Agrotis ipsilon*, black cutworm; *Schizaphis graminum*, greenbug; *Blissus leucopterus leucopterus*, chinch bug; *Acrosternum hilare*, green stink bug; *Euschistus serous*, brown stink bug; *Delia platura*, seedcom maggot; *Mayetiola destructor*, Hessian fly, *Petrobia latens*, brown wheat mite; insects of Oil Seed Rape: *Brevicoryne brassicae*, cabbage aphid; *Phyllotreta cruciferae*, Flea beetle; *Mamestra configurata*, Bertha armyworm; *Plutella xylostella*, Diamondback moth; *Delia* ssp., and Root maggots.

According to some embodiments of the invention, the insect is selected from the group consisting of: Beet Armyworm (BAW) (*Spodoptera exigua*) (the order of Lepidoptera), *Lygus* (*Lygus hesperus*) (the order Hemiptera), Cabbage Loopers (*Trichoplusia ni*) (the order Lepidoptera), Diamondback Moth (*Plutella xylostella*) (the order Lepidoptera), Fall armyworm (*Spodoptera frugiperda*) (the order Lepidoptera), Western corn rootworm (*Diabrotica virgifera virgifera*) (the order of Coleoptera), Green Peach Aphids (*Myzus persicae*) (the order of Hemiptera), and Soybean Looper (*Chrysodeixis includens*) (the order Lepidoptera).

The present inventors have further validated the ability of the isolated polynucleotides, constructs and polypeptides encoded thereby to increase the resistance of the plants to various insects. Exemplary non-limiting experiments are described in Examples 19-20 of the Examples section below.

According to an aspect of some embodiments of the invention there is provided a plant cell transformed with the nucleic acid construct of some embodiments of the invention.

According to an aspect of some embodiments of the invention there is provided a plant cell transformed with a nucleic acid construct comprising an isolated polynucleotide comprising a nucleic acid sequence encoding a polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more homologous to an amino acid sequence selected from the group consisting of SEQ ID NOs: 249-495, 632-655 and 656-697 and a promoter operably linked thereto, wherein the promoter is capable of directing transcription of the nucleic acid sequence in the plant cell.

According to an aspect of some embodiments of the invention there is provided a plant cell expressing a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more homologous to an amino acid sequence selected from the group consisting of SEQ ID NOs: 249-495, 632-655 and 656-697.

According to some embodiments of the invention the polypeptide is capable of killing or inhibiting the development of an insect.

According to an aspect of some embodiments of the invention there is provided a plant comprising the plant cell of some embodiments of the invention.

The term "plant" as used herein encompasses a whole plant, a grafted plant, ancestor(s) and progeny of the plants and plant parts, including seeds, shoots, stems, roots (including tubers), rootstock, scion, and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising Acacia spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeriajaponica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorycnium rectum, Echinochloa pyramidalis, Ehraffa* spp., *Eleusine coracana, Eragrestis* spp., *Erythrina* spp., *Eucalypfus* spp., *Euclea schimperi, Eulalia villosa, Pagopyrum* spp., *Feijoa sellowlana, Fragaria* spp., *Flemingia* spp, *Freycinetia banksli, Geranium thunbergii, GinAgo biloba, Glycine javanica, Gliricidia* spp, *Gossypium hirsutum, Grevillea* spp., *Guibourtia coleosperma, Hedysarum* spp., *Hemaffhia altissima, Heteropogon contoffis, Hordeum vulgare, Hyparrhenia rufa, Hypericum erectum, Hypefjhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robiniapseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays,* amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention, the plant is a host plant of the insect of some embodiments of the invention.

According to some embodiments of the invention, the insect is of an insect order selected from the group consisting of Lepidoptera, Coleoptera, Hemiptera, and Acari.

According to some embodiments of the invention, the insect is selected from the group consisting of Beet Armyworm (BAW) (*Spodoptera exigua*), Lygus (*Lygus hesperus*), Cabbage Loopers (*Trichoplusia ni*, Diamondback Moth (*Plutella xylostella*), Fall armyworm (*Spodoptera frugiperda*), Western corn rootworm (*Diabrotica virgifera virgifera*), Green Peach Aphids (*Myzus persicae*), Soybean Looper (*Chrysodeixis includens*) and Twospotted spider mite (*Tetranychus urticae*).

According to some embodiments of the invention, wherein when the insect is Beet Armyworm (*Spodoptera exigua*) then the plant is from a plant family selected from the group consisting of: Poaceae, Malvaceae, Liliaceae, Amaranthaceae, Fabaceae, Solanaceae, Chenopodiaceae, Brassicaceae, Solanaceae, Cyperaceae, Juglandaceae, Asteraceae, Cucurbitaceae, Rutaceae, Euphorbiaceae, Convolvulaceae, Caryophyllaceae, Apiaceae, Polygonaceae, Rosaceae, Iridaceae, Musaceae, Geraniaceae, Platanaceae, Apocynaceae, Portulacaceae, Rosaceae, Ericaceae, Violaceae, Vitaceae, and Zingiberaceae.

According to some embodiments of the invention, wherein when the insect is Cabbage Looper (*Trichoplusia ni*) then the plant is from a plant family selected from the group consisting of: crucifers (e.g., broccoli, cabbage, cauliflower, Chinese cabbage, collards, kale, mustard, radish, rutabaga, turnip, and watercress), beet, cantaloupe, celery, cucumber, lima bean, lettuce, parsnip, pea, pepper, potato, snap bean, spinach, squash, sweet potato, tomato, watermelon, chrysanthemum, hollyhock, snapdragon, sweetpea, cotton, tobacco, *Chenopodium album, Lactuca* spp. (wild lettuce), *Taraxacum oficinale* (dandelion), and *Rumex crispus* (curly dock).

According to some embodiments of the invention, wherein when the insect is Diamondback Moth (*Plutella xylostella*) then the plant is from a plant family selected from the group consisting of: Malvaceae, Brassicaceae, Capparaceae, Asteraceae and Fabaceae.

According to some embodiments of the invention, wherein when the insect is Green Peach Aphid (*Myzus persicae*) then the plant is from a plant family selected from the group consisting of: Malvaceae, Euphorbiaceae, Aloaceae, Boraginaceae, Apiaceae, Scrophulariaceae, Araceae, Fabaceae, Brassicaceae, Asteraceae, Liliaceae, Chenopodiaceae, Solanaceae, Caricaceae, Apocynaceae, Cucurbitaceae, Rutaceae, Convolvulaceae, Iridaceae, Rosaceae, Caryophyllaceae, Euphorbiaceae, Iridaceae, Malvaceae, Poaceae, Cannabaceae, Balsaminaceae, Convolvulaceae, Poaceae, Lamiaceae, Papaveraceae, Lauraceae, Myrtaceae, Punicaceae, Anacardiaceae, Polygonaceae, and Pedaliaceae.

According to some embodiments of the invention, the insect is Soybean Looper (*Chrysodeixis includens*) then the plant is from a plant family selected from the group consisting of: Amaranthaceae, Apiaceae, Araceae, Araliaceae, Asteraceae, Begoniaceae, Brassicaceae, Caryophyllaceae, Chenopodiaceae, Convolvulaceae, Cucurbitaceae, Euphorbiaceae, Fabaceae, Geraniaceae, Gesneriaceae, Hydrangeaceae, Lamiaceae, Lauraceae, Liliaceae, Malvaceae, Passifloraceae, Piperaceae, Poaceae, Polygonaceae, Portulacaceae, Rubiaceae, and Solanaceae.

According to some embodiments of the invention, the insect is Fall armyworm (*Spodoptera frugiperda*) then the plant is from a plant family selected from the group consisting of: Amaranthaceae, Apiaceae, Apocynaceae, Asteraceae, Brassicaceae, Caryophyllaceae, Chenopodiaceae, Convolvulaceae, Cucurbitaceae, Cyperaceae, Euphorbiaceae, Fabaceae, Geraniaceae, Iridaceae, Juglandaceae, Liliaceae, Malvaceae, Musaceae, Platanaceae, Poaceae, Poaceae, Polygonaceae, Portulacaceae, Rosaceae, Rutaceae, Solanaceae, Ericaceae, Violaceae, Vitaceae, and Zingiberaceae.

According to some embodiments of the invention, the insect is Western corn rootworm (*Diabrotica virgifera virgifera*) then the plant is from a plant family selected from the group consisting of: Asteraceae, Cucurbitaceae, Fabaceae, and Poaceae.

According to some embodiments of the invention, the insect is Lygus (*Lygus hesperus*) then the plant is from a plant family selected from the group consisting of: Cruciferae, Fabaceae, Malvaceae, Rosaceae, and Umbelliferae.

Non-limiting examples of host plants of the insects of some embodiments of the invention include:
1. Host plants for the Beet Armyworm (BAW) (*Spodoptera exigua*) as described in Table 3 below;
2. Host plants for the Diamondback Moth (*Plutella xylostella*) as described in Table 4 below;
3. Host plants for the Green Peach Aphids (*Myzus persicae*) as described in Table 5 below;
4. Host plants for the Western corn rootworm (*Diabrotica virgifera virgifera*) as described in Table 6 below;
5. Host plants for the Fall armyworm (*Spodoptera frugiperda*) are described in Table 7 below;
6. Host plants for the Soybean Looper (*Chrysodeixis includens*) as described in Table 8 below;
7. Host plants for the Lygus (*Lygus hesperus*) as described in Table 9 below;
8. Host plants for the Cabbage Loopers (*Trichoplusia ni*) as described in Table 10 hereinunder; and
9. Host plants for the Two spotted spider mite as described in Table 11 hereinunder.

Thus, killing or inhibiting the growth of the insects of some embodiments of the invention will be highly beneficial for the plants hosting these insects, thus protecting, rescuing and/or treating the plants from the deleterious effects of the insects.

TABLE 3

Insect Host Plants for Beet Armyworm (*Spodoptera exigua*)

| Plane name | Family | Context |
|---|---|---|
| *Agrostis* (bentgrasses) | Poaceae | Wild host |
| *Agrostis gigantea* (black bent) | Poaceae | Other |
| *Alcea rosea* (Hollyhock) | Malvaceae | Other |
| *Allium* | Liliaceae | Main |
| *Allium cepa* (onion) | Liliaceae | Other |
| *Amaranthus* (amaranth) | Amaranthaceae | Other |
| *Andropogon virginicus* (broomsedge) | Poaceae | Wild host |
| *Arachis hypogaea* (groundnut) | Fabaceae | Main |
| *Asparagus officinalis* (asparagus) | Lillaceae | Other |
| *Atropa belladonna* (deadly nightshade) | Solanaceae | Wild host |
| *Avena sativa* (oats) | Poaceae | Other |
| *Beta* | Chenopodiaceae | Other |
| *Beta vulgaris* (beetroot) | Chenopodiaceae | Other |
| *Beta vulgaris* var. *saccharifera* (sugarbeet) | Chenopodiaceae | Main |
| *Brassica oleracea* (cabbages, cauliflowers) | Brassicaceae | Main |
| *Brassica oleracea* var. *capitata* (cabbage) | Brassicaceae | Other |
| *Brassica oleracea* var. *viridis* (collards) | Brassicaceae | Other |
| *Brassica rapa* subsp. *oleifera* (turnip rape) | Brassicaceae | Other |
| *Brassica rapa* subsp. *rapa* (turnip) | Brassicaceae | Main |
| *Brassicaceae* (cruciferous crops) | Brassicaceae | Main |
| *Capsicum* (peppers) | Solanaceae | Other |
| *Capsicum annuum* (bell pepper) | Solanaceae | Main |
| *Carex* (sedges) | Cyperaceae | Wild host |
| *Carya* (hickories) | Juglandaceae | Other |
| *Carya illinoinensis* (pecan) | Juglandaceae | Other |
| *Cenchrus incertus* (Spiny burrgrass) | Poaceae | Wild host |
| *Chenopodium album* (fat hen) | Chenopodiaceae | Wild host |
| *Chenopodium quinoa* (quinoa) | Chenopodiaceae | Other |
| *Chloris gayana* (rhodes grass) | Poaceae | Other |
| *Chrysanthemum* (daisy) | Asteraceae | Other |
| *Chrysanthemum morifolium* (chrysanthemum (florists')) | Asteraceae | Main |
| *Cicer arietinum* (chickpea) | Fabaceae | Other |
| *Citrullus lanatus* (watermelon) | Cucurbitaceae | Other |
| *Citrus aurantium* (sour orange) | Rutaceae | Other |
| *Citrus limon* (lemon) | Rutaceae | Other |
| *Citrus reticulata* (mandarin) | Rutaceae | Other |
| *Citrus sinensis* (navel orange) | Rutaceae | Other |
| *Codiaeum variegatum* (croton) | Euphorbiaceae | Other |
| *Convolvulus* (morning glory) | Convolvulaceae | Wild host |
| *Cucumis sativus* (cucumber) | Cucurbitaceae | Main |
| *Cucurbitaceae* (cucurbits) | Cucurbitaceae | Main |
| *Cyperus rotundus* (purple nutsedge) | Cyperaceae | Other |
| *Dahlia pinnata* (garden dahlia) | Asteraceae | Other |
| *Dianthus caryophyllus* (carnation) | Caryophyllaceae | Main |
| *Echinochloa colona* (junglerice) | Poaceae | Other |
| *Eryngium foetidum* | Apiaceae | Other |
| *Fagopyrum esculentum* (buckwheat) | Polygonaceae | Other |
| *Fragaria ananassa* (strawberry) | Rosaceae | Other |
| *Fragaria chiloensis* (Chilean strawberry) | Rosaceae | Other |
| *Gladiolus hybrids* (sword lily) | Iridaceae | Other |
| *Glycine max* (soyabean) | Fabaceae | Main |
| *Gossypium* (cotton) | Malvaceae | Main |
| *Gossypium herbaceum* (short staple cotton) | Malvaceae | Other |
| *Hevea brasiliensis* (rubber) | Euphorbiaceae | Other |
| *Hibiscus cannabinus* (kenaf) | Malvaceae | Other |
| *Hordeum vulgare* (barley) | Poaceae | Other |
| *Ipomoea batatas* (sweet potato) | Convolvulaceae | Main |
| *Ipomoea purpurea* (tall morning glory) | Convolvulaceae | Wild host |
| *Lactuca sativa* (lettuce) | Asteraceae | Other |
| *Malus domestica* (apple) | Rosaceae | Other |
| *Medicago sativa* (lucerne) | Fabaceae | Main |
| *Mucuna pruriens* (velvet bean) | Fabaceae | Other |
| *Musa* (banana) | Musaceae | Main |
| *Nicotiana tabacum* (tobacco) | Solanaceae | Main |
| *Oryza sativa* (rice) | Poaceae | Main |
| *Panicum miliaceum* (millet) | Poaceae | Other |
| *Pelargonium* (pelargoniums) | Geraniaceae | Main |
| *Pennisetum clandestinum* (kikuyu grass) | Poaceae | Other |
| *Pennisetum glaucum* (pearl millet) | Poaceae | Other |
| *Phaseolus* (beans) | Fabaceae | Main |
| *Phaseolus vulgaris* (common bean) | Fabaceae | Main |
| *Phleum pratense* (timothy grass) | Poaceae | Other |
| *Pisum sativum* (pea) | Fabaceae | Other |
| *Platanus occidentalis* (sycamore) | Platanaceae | Other |
| *Plumeria* (frangipani) | Apocynaceae | Other |

TABLE 3-continued

Insect Host Plants for Beet Armyworm (*Spodoptera exigua*)

| Plant name | Family | Context |
|---|---|---|
| *Poa annua* (annual meadowgrass) | *Poaceae* | Other |
| *Poa pratensis* (smooth meadow-grass) | *Poaceae* | Other |
| *Poaceae* (grasses) | *Poaceae* | Main |
| *Portulaca oleracea* (purslane) | *Portulacaceae* | Other |
| *Prunus persica* (peach) | *Rosaceae* | Other |
| *Saccharum efficinarum* (sugarcane) | *Poaceae* | Main |
| *Secale cereale* (rye) | *Poaceae* | Other |
| *Setaria italica* (foxtail millet) | *Poaceae* | Other |
| *Setaria viridis* (green foxtail) | *Poaceae* | Other |
| *Solanum* (nightshade) | *Solanaceae* | Wild host |
| *Solanum lycopersicum* (tomato) | *Solanaceae* | Main |
| *Solanum melongena* (aubergine) | *Solanaceae* | Main |
| *Solanum tuberosum* (potato) | *Solanaceae* | Main |
| *Sorghum bicolor* (sorghum) | *Poaceae* | Main |
| *Sorghum caffrorum* | *Poaceae* | Other |
| *Sorghum halepense* (Johnson grass) | *Poaceae* | Other |
| *Sorghum sudanense* (Sudan grass) | *Poaceae* | Other |
| *Spinacia oleracea* (spinach) | *Chenopodiaceae* | Main |
| *Trifolium* (clovers) | *Fabaceae* | Main |
| *Trifolium pratense* (purple clover) | *Fabaceae* | Other |
| *Trifolium repens* (white clover) | *Fabaceae* | Other |
| *Triticum aestivum* (wheat) | *Poaceae* | Other |
| Turfgrasses | | Other |
| *Urochloa* | *Poaceae* | Wild host |
| *Vaccinium corymbosum* (blueberry) | *Ericaceae* | Other |
| *Vigna unguiculata* (cowpea) | *Fabaceae* | Other |
| *Viola* (violet) | *Violaceae* | Other |
| *Vitis* (grape) | *Vitaceae* | Other |
| *Vitis vinifera* (grapevine) | *Vitaceae* | Other |
| *Xanthium strumarium* (common cocklebur) | *Asteraceae* | Wild host |
| *Zea mays* (maize) | *Poaceae* | Main |
| *Zea mays* subsp. *mays* (sweetcorn) | *Poaceae* | Main |
| *Zea mays* subsp. *mexicana* (teosinte) | *Poaceae* | Other |
| *Zingiber officinale* (ginger) | *Zingiberaceae* | Main |

Table 3.

TABLE 4

Insect Host Plants for Diamondback Moth (*Plutella xylostella*)

| Plant name | Family | Context |
|---|---|---|
| *Abelmoschus esculentus* (okra) | *Malvaceae* | Other |
| *Arabidapsis thaliana* | *Brassicaceae* | Wild host |
| *Armoracia rusticana* (horseradish) | *Brassicaceae* | Main |
| *Brassica* | *Brassicaceae* | Main |
| *Brassica juncea* var. *juncea* (Indian mustard) | *Brassicaceae* | Main |
| *Brassica napus* var. *napus* (rape) | *Brassicaceae* | Main |
| *Brassica nigra* (black mustard) | *Brassicaceae* | Main |
| *Brassica oleracea* (cabbages, cauliflowers) | *Brassicaceae* | Main |
| *Brassica oleracea* var. *botrytis* (cauliflower) | *Brassicaceae* | Main |
| *Brassica oleracea* var. *capitata* (cabbage) | *Brassicaceae* | Main |
| *Brassica oleracea* var. *gemmifera* (Brussels sprouts) | *Brassicaceae* | Main |
| *Brassica oleracea* var. *gongylodes* (kohlrabi) | *Brassicaceae* | Main |
| *Brassica oleracea* var. *italica* (broccoli) | *Brassicaceae* | Main |
| *Brassica oleracea* var. *viridis* (collards) | *Brassicaceae* | Main |
| *Brassica rapa* cultivar group Caixin | *Brassicaceae* | Main |
| *Brassica rapa* subsp. *chinensis* (Chinese cabbage) | *Brassicaceae* | Main |
| *Brassica rapa* subsp. *pekinensis* | *Brassicaceae* | Main |
| *Brassica rapa* subsp. *rapa* (turnip) | *Brassicaceae* | Main |
| *Brassicaceae* (cruciferous crops) | *Brassicaceae* | Main |
| Capseila bursa-pastoris (shepherd's purse) | *Brassicaceae* | Wild host |
| *Cleome rutidosperma* (fringed spiderflower) | *Capparaceae* | Other |
| *Descurainia sophia* (flixweed) | *Brassicaceae* | Wild host |
| *Erysimum cheiranthoides* (Treacle mustard) | *Brassicaceae* | Wild host |
| *Lactuca sativa* (lettuce) | *Asteraceae* | Other |
| *Nasturtium officinale* (watercress) | *Brassicaceae* | Main |
| *Pisum sativum* (pea) | *Fabaceae* | Other |
| *Raphanus raphanistrum* (wild radish) | *Brassicaceae* | Wild host |
| *Raphanus sativus* (radish) | *Brassicaceae* | Main |
| *Sinapis alba* (white mustard) | *Brassicaceae* | Main |
| *Sinapis arvensis* (wild mustard) | *Brassicaceae* | Wild host |
| *Sisymbrium altissimum* (Tall rocket) | *Brassicaceae* | Wild host |
| *Thlaspi arvense* (field pennycress) | *Brassicaceae* | Wild host |

Table 4.

TABLE 5

Insect Host Plants for Green Peach Aphid (*Myzus persicae*)

| Plant name | Family | Context |
|---|---|---|
| *Abelmoschus esculentus* (okra) | *Malvaceae* | Other |
| *Aleurites* | *Euphorbiaceae* | Other |
| *Aloe* (grey alder) | *Aloaceae* | Other |
| *Anchusa* (Bugloss) | *Boraginaceae* | Wild host |
| *Anethum graveolens* (dill) | *Apiaceae* | Other |
| *Anthriscus* (chervil) | *Apiaceae* | Wild host |
| *Antirrhinum* (snapdragon) | *Scrophulariaceae* | Wild host |
| *Apium graveolens* (celery) | *Apiaceae* | Main |
| *Araceae* | *Araceae* | Main |
| *Arachis hypogaea* (groundnut) | *Fabaceae* | Main |
| *Armoracia rusticana* (horseradish) | *Brassicaceae* | Main |
| *Artemisia* (wormwoods) | *Asteraceae* | Wild host |
| *Asparagus officinalis* (asparagus) | *Liliaceae* | Main |
| *Beta vulgaris* var. *saccharifera* (sugarbeet) | *Chenopodiaceae* | Main |
| *Brassica* | *Brassicaceae* | Main |
| *Brassica oleracea* (cabbages, cauliflowers) | *Brassicaceae* | Unknown |
| *Brassica oleracea* var. *viridis* (collards) | *Brassicaceae* | Other |
| *Brassica rapa* cultivar group Caixin | *Brassicaceae* | Other |
| *Brassica rapa* subsp. *chinensis* (Chinese cabbage) | *Brassicaceae* | Main |
| *Cajanus cajan* (pigeon pea) | *Fabaceae* | Main |
| *Capsella bursa-pastoris* (shepherd's purse) | *Brassicaceae* | Wild host |
| *Capsicum* (peppers) | *Solanaceae* | Main |
| *Capsicum annuum* (bell pepper) | *Solanaceae* | Main |
| *Carica papaya* (pawpaw) | *Caricaceae* | Main |
| *Carthamus tinctorius* (safflower) | *Asteraceae* | Other |
| *Catharanthus roseus* (Madagascar periwinkle) | *Apocynaceae* | Other |
| *Chenopodium* (Goosefoot) | *Chenopodiaceae* | Wild host |
| *Chenopodium quinoa* (quinoa) | *Chenopodiaceae* | Other |
| *Chrysanthemum* (daisy) | *Asteraceae* | Main |
| *Chrysanthemum indicum* (chrysanthemum) | *Asteraceae* | Other |
| *Cichorium intybus* (chicory) | *Asteraceae* | Main |
| *Citrullus lanatus* (watermelon) | *Cucurbitaceae* | Main |
| *Citrus* | *Rutaceae* | Main |
| *Colocasia esculenta* (taro) | *Araceae* | Main |
| *Convallaria majalis* (lily of the valley) | *Liliaceae* | Other |
| *Convolvulus* (morning glory) | *Convolvulaceae* | Wild host |
| *Coriandrum sativum* (coriander) | *Apiaceae* | Main |
| *Crocus sativus* (saffron) | *fridaceae* | Other |
| *Cucumis* (melons, cucuimbers, gerkins) | *Cucurbitaceae* | Main |
| *Cucurbita* (pumpkin) | *Cucurbitaceae* | Main |
| *Cucurbita moschata* (pumpkin) | *Cucurbitaceae* | Other |
| *Cucurbita pepo* (marrow) | *Cucurbitaceae* | Other |
| *Cuminum cyminum* (cumin) | *Apiaceae* | Main |
| *Cydonia oblonga* (quince) | *Rosaceae* | Other |
| *Cynara cardunculus* var. *scolymus* (globe artichoke) | *Asteraceae* | Main |
| *Cyphomandra betacea* (tree tomato) | *Solanaceae* | Other |
| *Dahlia* | *Asteraceae* | Other |
| *Daucus carom* (carrot) | *Apiaceae* | Main |
| *Dianthus* (carnation) | *Caryophyllaceae* | Other |
| *Dianthus caryophyllus* (carnation) | *Caryophyllaceae* | Main |
| *Euphorbia* (spurges) | *Euphorbiaceae* | Wild host |
| *Foeniculum vulgare* (fennel) | *Apiaceae* | Other |
| *Fragaria chiloensis* (Chilean strawberry) | *Rosaceae* | Main |
| *Gladiolus hybrids* (sword lily) | *Iridaceae* | Other |
| *Glycine max* (soyabean) | *Fabaceae* | Other |
| *Gossypium* (cotton) | *Malvaceae* | Main |
| *Hemerocallis* (daylilies) | *Liliacecte* | Other |
| *Hordeum vulgare* (barley) | *Poaceae* | Main |
| *Humulus lupulus* (hop) | *Cannabaceae* | Other |

TABLE 5-continued

Insect Host Plants for Green Peach Aphid (*Myzus persicae*)

| Plant name | Family | Context |
|---|---|---|
| Impatiens (balsam) | Balsaminaceae | Wild host |
| Indigolera (indigo) | Fabaceae | Other |
| Ipomoea batatas (sweet potato) | Convolvulaceae | Main |
| Iris (irises) | Iridaceae | Other |
| Lactuca sativa (lettuce) | Asteraceae | Main |
| Lavandula angustifolia (lavender) | Lamiaceae | Other |
| Lepidium sativum (garden cress) | Brassicaceae | Other |
| Lepidium virginicum (Virginian peppercress) | Brassicaceae | Other |
| Lilium (lily) | Lillaceae | Other |
| Lolium (ryegrasses) | Poaceae | Main |
| Lolium multiflorum (Italian ryegrass) | Poaceae | Wild host |
| Lupinus (lupins) | Fabaceae | Main |
| Malus domestica (apple) | Rosaceae | Main |
| Malva (mallow) | Malvaceae | Wild host |
| Matthiola | Brassicaceae | Other |
| Medicago sativa (lucerne) | Fabaceae | Main |
| Mentha (mints) | Lamiaceae | Other |
| Narcissus (daffodil) | Lillaceae | Other |
| Nasturtium officinale (watercress) | Brassicaceae | Other |
| Nicotiana tabacum (tobacco) | Solanaceae | Main |
| Origanum majorana (sweet marjoram) | Lamiaceae | Main |
| Papaver somniferum (Opium poppy) | Papaveraceae | Main |
| Passflora edulis (passionfruit) | Passifloraceae | Other |
| Pastinaca sativa (parsnip) | Apiaceae | Main |
| Persea americana (avocado) | Lauraceae | Other |
| Petroselinum (parsley) | Apiaceae | Main |
| Phaseolus (beans) | Fabaceae | Main |
| Pisum sativum (pea) | Fabaceae | Other |
| Poa (meadow grass) | Poaceae | Main |
| Prunus (stone fruit) | Rosaceae | Main |
| Prunus amygdalus | Rosaceae | Other |
| Prunus armeniaca (apricot) | Rosaceae | Main |
| Prunus mume (Japanese apricot tree) | Rosaceae | Other |
| Prunus nana | Rosaceae | Other |
| Prunus nigra (Canada plumtree) | Rosaceae | Other |
| Prunus persica (peach) | Rosaceae | Main |
| Prunus serotina (black cherry) | Rosaceae | Other |
| Psidium guajava (guava) | Myrtaceae | Other |
| Punica granatum (pomegranate) | Punicaceae | Other |
| Raphanus sativus (radish) | Brassicaceae | Main |
| Rhus (Sumach) | Anacardiaceae | Other |
| Rosa (roses) | Rosaceae | Other |
| Rumex acetosa var. hortensis (garden sorrel) | Polygonaceae | Other |
| Saccharum officinarum (sugarcane) | Poaceae | Main |
| Secale cereale (rye) | Poaceae | Other |
| Senecio (Groundsel) | Asteraceae | Wild host |
| Senecio vulgaris | Asteraceae | Wild host |
| Sesamum indicum (sesame) | Pedaliaceae | Main |
| Solanum lycopersicum (tomato) | Solanaceae | Main |
| Solanum melongena (aubergine) | Solanaceae | Main |
| Solanum nigrum (black nightshade) | Solanaceae | Other |
| Solanum tuberosum (potato) | Solanaceae | Main |
| Spinacia oleracea (spinach) | Chenopodiaceae | Main |
| Trifolium (clovers) | Fabaceae | Main |
| Trigonella foenum-graecum (fenugreek) | Fabaceae | Other |
| Triticum (wheat) | Poaceae | Main |
| Tulipa (tulip) | Liliacecte | Other |
| Vicia (vetch) | Fabaceae | Main |
| Vigna unguiculata (cowpea) | Fabaceae | Other |
| Zea mays (maize) | Poaceae | Main |

Table 5.

TABLE 6

Insect Host Plants for Western corn rootworm (*Diabrotica virgifera virgifera*)

| Plant name | Family | Context |
|---|---|---|
| Cucurbita (pumpkin) | Cucurbitaceae | Other |
| Cucurbita pepo (marrow) | Cucurbitaceae | Other |
| Cucurbitaceae (cucurbits) | Cucurbitaceae | Other |
| Fabaceae (leguminous plants) | Fabaceae | Other |
| Glycine max (soyabean) | Fabaceae | Other |
| Helianthus annuus (sunflower) | Asteraceae | Other |
| Hordeum (barleys) | Poaceae | Other |
| Panicum (millets) | Poaceae | Other |
| Poaceae (grasses) | Poaceae | Main |
| Polyphagous (polyphagous) | | Other |
| Setaria (Foxtailmillet) | Poaceae | Other |
| Tripsacum dactyloides (eastern gamagrass (USA)) | Poaceae | Other |
| Triticum (wheat) | Poaceae | Other |
| Zea mays (maize) | Poaceae | Main |

Table 6.

TABLE 7

Insect Host Plants for Fall armyworm (*Spodoptera frugiperda*)

| Plant name | Family | Context |
|---|---|---|
| Agrostis (bentgrasses) | Poaceae | Wild host |
| Agrostis gigantea (black bent) | Poaceae | Other |
| Alcea rosea (Hollyhock) | Malvaceae | Other |
| Allium | Liliaceae | Main |
| Allium cepa (onion) | Liliaceae | Other |
| Amaranthus (amaranth) | Amaranthaceae | Other |
| Andropogon virginicus (broomsedge) | Poaceae | Wild host |
| Arachis hypogaea (groundnut) | Fabaceae | Main |
| Asparagus officinalis (asparagus) | Liliaceae | Other |
| Atropa belladonna (deadly nightshade) | Solanaceae | Wild host |
| Avena sativa (oats) | Poaceae | Other |
| Beta | Chenopodiaceae | Other |
| Beta vulgaris (beetroot) | Chenopodiaceae | Other |
| Beta vulgaris var. saccharifera (sugarbeet) | Chenopodiaceae | Main |
| Brassica oleracea (cabbages, cauliflowers) | Brassicaceae | Main |
| Brassica oleracea var. capitata (cabbage) | Brassicaceae | Other |
| Brassica oleracea var. viridis (collards) | Brassicaceae | Other |
| Brassica rapa subsp. oleifira (turnip rape) | Brassicaceae | Other |
| Brassica rapa subsp. rapa (turnip) | Brassicaceae | Main |
| Brassicaceae (cruciferous crops) | Brassicaceae | Main |
| Capsicum (peppers) | Solanaceae | Other |
| Capsicum annuum (bell pepper) | Solanaceae | Main |
| Carex (sedges) | Cyperaceae | Wild host |
| Carya (hickories) | Juglandaceae | Other |
| Carya illinoinensis (pecan) | Juglandaceae | Other |
| Cenchrus incertus (Spiny burrgrass) | Poaceae | Wild host |
| Chenopodium album (fat hen) | Chenopodiaceae | Wild host |
| Chenopodium quinoa (quinoa) | Chenopodiaceae | Other |
| Chloris gayana (rhodes grass) | Poaceae | Other |
| Chrysanthemum (daisy) | Asteraceae | Other |
| Chrysanthemum morifolium (chrysanthemum (florists')) | Asteraceae | Main |
| Cicer arietinum (chickpea) | Fabaceae | Other |
| Citrullus lanatus (watermelon) | Cucurbitaceae | Other |
| Citrus aurantium (sour orange) | Rutaceae | Other |
| Citrus limon (lemon) | Rutaceae | Other |
| Citrus reticulata (mandarin) | Rutaceae | Other |
| Citrus sinensis (navel orange) | Rutaceae | Other |
| Codiaeum variegatum (croton) | Euphorbiaceae | Other |
| Convolvulus (morning glory) | Convolvulaceae | Wild host |
| Cucumis sativus (cucumber) | Cucurbitaceae | Main |
| Cucurbitaceae (cucurbits) | Cucurbitaceae | Main |
| Cyperus rotundus (purple nutsedge) | Cyperaceae | Other |
| Dahlia pinnata (garden dahlia) | Asteraceae | Other |
| Dianthus caryophyllus (carnation) | Caryophyllaceae | Main |
| Echinochloa colona (junglerice) | Poaceae | Other |
| Eryngium foetidum | Apiaceae | Other |
| Fagopyrum esculentum (buckwheat) | Polygonaceae | Other |
| Fragaria ananassa (strawberry) | Rosaceae | Other |
| Fragaria chiloensis (Chilean strawberry) | Rosaceae | Other |
| Gladiolus hybrids (sword lily) | Iridaceae | Other |

TABLE 7-continued

Insect Host Plants for Fall armyworm (*Spodoptera frugiperda*)

| Plant name | Family | Context |
|---|---|---|
| *Glycine max* (soyabean) | Fabaceae | Main |
| *Gossypium* (cotton) | Malvaceae | Main |
| *Gossypium herbaceum* (short staple cotton) | Malvaceae | Other |
| *Hevea brasiliensis* (rubber) | Euphorbiaceae | Other |
| *Hibiscus cannabinus* (kenaf) | Malvaceae | Other |
| *Hordeum vulgare* (barley) | Poaceae | Other |
| *Ipomoea batatas* (sweet potato) | Convolvulaceae | Main |
| *Ipomoea purpurea* (tall morning glory) | Convolvulaceae | Wild host |
| *Lactuca sativa* (lettuce) | Asteraceae | Other |
| *Malus domestica* (apple) | Rosaceae | Other |
| *Medicago sativa* (lucerne) | Fabaceae | Main |
| *Mucuna pruriens* (velvet bean) | Fabaceae | Other |
| *Musa* (banana) | Musaceae | Main |
| *Nicotiana tabacum* (tobacco) | Solanaceae | Main |
| *Oryza sativa* (rice) | Poaceae | Main |
| *Panicum miliaceum* (millet) | Poaceae | Other |
| *Pelargonium* (pelargoniums) | Geraniaceae | Main |
| *Pennisetum clandestinum* (kikuyu grass) | Poaceae | Other |
| *Pennisetum glaucum* (pearl millet) | Poaceae | Other |
| *Phaseolus* (beans) | Fabaceae | Main |
| *Phaseolus vulgaris* (common bean) | Fabaceae | Main |
| *Phleum pratense* (timothy grass) | Poaceae | Other |
| *Pisum sativum* (pea) | Fabaceae | Other |
| *Platanus occidentalis* (sycamore) | Platanaceae | Other |
| *Plumeria* (frangipani) | Apocynaceae | Other |
| *Poa annua* (annual meadowgrass) | Poaceae | Other |
| *Poa pratensis* (smooth meadow-grass) | Poaceae | Other |
| *Poaceae* (grasses) | Poaceae | Main |
| *Portulaca oleracea* (purslane) | Portulacaceae | Other |
| *Prunus persica* (peach) | Rosaceae | Other |
| *Saccharum officinarum* (sugarcane) | Poaceae | Main |
| *Secale cereale* (rye) | Poaceae | Other |
| *Setaria italica* (foxtail millet) | Poaceae | Other |
| *Setaria viridis* (green foxtail) | Poaceae | Other |
| *Solanum* (nightshade) | Solanaceae | Wild host |
| *Solanum lycopersicum* (tomato) | Solanaceae | Main |
| *Solanum melongena* (aubergine) | Solanaceae | Main |
| *Solanum tuberosum* (potato) | Solanaceae | Main |
| *Sorghum bicolor* (sorghum) | Poaceae | Main |
| *Sorghum caffrorum* | Poaceae | Other |
| *Sorghum halepense* (Johnson grass) | Poaceae | Other |
| *Sorghum sudanense* (Sudan grass) | Poaceae | Other |
| *Spinacia oleracea* (spinach) | Chenopodiaceae | Main |
| *Trifolium* (clovers) | Fabaceae | Main |
| *Trifolium pratense* (purple clover) | Fabaceae | Other |
| *Trifolium repens* (white clover) | Fabaceae | Other |
| *Triticum aestivum* (wheat) | Poaceae | Other |
| Turfgrasses | | Other |
| *Urochloa* | Poaceae | Wild host |
| *Vaccinium corymbosum* (blueberry) | Erieaceae | Other |
| *Vigna unguiculata* (cowpea) | Fabaceae | Other |
| *Viola* (violet) | Violaceae | Other |
| *Vitis* (grape) | Vitaceae | Other |
| *Vitis vinifera* (grapevine) | Vitaceae | Other |
| *Xanthium strumarium* (common cocklebur) | Asteraceae | Wild host |
| *Zea mays* (maize) | Poaceae | Main |
| *Zea mays* subsp. *mays* (sweetcorn) | Poaceae | Main |
| *Zea mays* subsp. *mexicana* (teosinte) | Poaceae | Other |
| *Zingiber officinale* (ginger) | Zingiberaceae | Main |

Table 7.

TABLE 8

Insect Host Plants for Soybean Looper (SBL; *Chrysodeixis includens*)

| Plant name | Family | Context |
|---|---|---|
| *Abelmoschus esculentus* (okra) | Malvaceae | Main |
| *Allium sativum* (garlic) | Lillaceae | Other |
| *Amaranthus* (amaranth) | Amaranthaceae | Wild host |
| *Apium graveolens* (celery) | Apiaceae | Other |
| *Arachis hypogaea* (groundnut) | Fabaceae | Other |
| *Asparagus officinalis* (asparagus) | Liliaceae | Other |
| *Aster* | Asteraceae | Wild host |
| *Begonia* | Begoniaceae | Other |
| *Brassica oleracea* (cabbages, cauliflowers) | Brassicaceae | Other |
| *Brassica oleracea* var. *italica* (broccoli) | Brassicaceae | Other |
| *Brassica oleracea* var. *viridis* (collards) | Brassicaceae | Other |
| *Brassicaceae* (cruciferous crops) | Brassicaceae | Main |
| *Cajanus cajan* (pigeon pea) | Fabaceae | Main |
| *Calendula officinalis* (Pot marigold) | Asteraceae | Wild host |
| *Capsicum annuum* (bell pepper) | Solanaceae | Other |
| *Chenopodium album* (fat hen) | Chenopodiaceae | Wild host |
| *Chrysanthemum* (daisy) | Asteraceae | Other |
| *Citrullus lanatus* (watermelon) | Cucurbitaceae | Other |
| *Cucumis sativus* (cucumber) | Cucurbitaceae | Unknown |
| *Cucurbitaceae* (cucurbits) | Cucurbitaceae | Main |
| *Cyamopsis tetragonoloba* (guar) | Fabaceae | Other |
| *Cyphomandra betacea* (tree tomato) | Solanaceae | Wild host |
| *Daucus carota* (carrot) | Apiaceae | Main |
| *Dianthus caryophyllus* (carnation) | Caryophyllaceae | Other |
| *Eryngium foetidum* | Apiaceae | Other |
| *Eupatorium* | Asteraceae | Wild host |
| *Euphorbia pulcherrima* (poinsettia) | Euphorbiaceae | Other |
| *Geranium* (cranesbill) | Geraniaceae | Other |
| *Gerbera jamesonii* (African daisy) | Asteraceae | Wild host |
| *Glycine max* (soyabean) | Fabaceae | Main |
| *Gossypium* (cotton) | Malvaceae | Main |
| *Gossypium hirsutum* (Bourbon cotton) | Malvaceae | Other |
| *Helianthus annuus* (sunflower) | Asteraceae | Other |
| *Hydrangea* (hydrangeas) | Hydrangeaceae | Wild host |
| *Ipomoea batatas* (sweet potato) | Convolvulaceae | Main |
| *Ixora coccinea* (flame of woods) | Rubiaceae | Wild host |
| *Lactuca saliva* (lettuce) | Asteraceae | Main |
| *Lantana* | Verbenaceae | Wild host |
| *Lepidium virginicum* (Virginian peppercress) | Brassicaceae | Wild host |
| *Matthiola incana* (stock) | Brassicaceae | Wild host |
| *Medicago sativa* (lucerne) | Fabaceae | Unknown |
| *Mentha* (mints) | Lamiaceae | Other |
| *Nasturtium officinale* (watercress) | Brassicaceae | Other |
| *Nicotiana rustica* (wild tobacco) | Solanaceae | Wild host |
| *Nicotiana tabacum* (tobacco) | Solanaceae | Other |
| *Passiflora edulis* (passionfruit) | Passifloraceae | Other |
| *Peperomia obtusifolia* (pepper-face) | Piperaceae | Other |
| *Persea americana* (avocado) | Lauraceae | Other |
| *Phaseolus* (beans) | Fabaceae | Main |
| *Phaseolus lunatus* (lima bean) | Fabaceae | Other |
| *Phaseolus vulgaris* (common bean) | Fabaceae | Unknown |
| *Philodendron* | Araceae | Wild host |
| *Physalis* (Groundcherry) | Solanaceae | Other |
| *Pisum sativum* (pea) | Fabaceae | Unknown |
| *Portulaca oleracea* (purslane) | Portulacaceae | Wild host |
| *Pueraria montana* var. *lobata* (kudzu) | Fabaceae | Other |
| *Rumex* (Dock) | Polygonaceae | Wild host |
| *Saccharum officinarum* (sugarcane) | Poaceae | Main |
| *Saintpaulia ionantha* (African violet) | Gesneriaceae | Other |
| *Schefflera actinophylla* (umbrella tree) | Araliaceae | Wild host |
| *Senecio bicolor* (dusty miller) | Asteraceae | Wild host |
| *Solanum* (nightshade) | Solanaceae | Wild host |
| *Solanum lycopersicum* (tomato) | Solanaceae | Main |
| *Solanum melongena* (aubergine) | Solanaceae | Main |
| *Solanum tuberosum* (potato) | Solanaceae | Other |
| *Solidago* (Goldenrod) | Asteraceae | Wild host |
| *Sonchus* (Sowthistle) | Asteraceae | Wild host |
| *Sorghum bicolor* (sorghum) | Poaceae | Main |
| *Verbena* (vervain) | Verbenaceae | Wild host |
| *Vigna unguiculata* (cowpea) | Fabaceae | Wild host |
| *Xanthium strumarium* (common cocklebur) | Asteraceae | Wild host |
| *Zea mays* (maize) | Poaceae | Main |

Table 8.

*Lygus Hesperus* has a reported host range of 110 plant species with two plant families (Asteraceae and Fabaceae) constituting 39% of its recorded hosts [Scott, D. R. 1977. An annotated list of host plants for *L. Lygus hesperus* Knight. Bulletin of the Entomological Society of America 23:19-22].

*L. Lygus hesperus* is considered a severe insect pest of the crops described herein below (Table 9).

TABLE 9

Insect Host Plants for Lygus (*Lygus hesperus*)

| Plant name | Family |
| --- | --- |
| *Apium graveolens* var. *dulce* | Umbelliferae |
| *Brassica napus* | Cruciferae |
| *Brassica oleracea* | Cruciferae |
| *Brassica oleracea* var. *acephala* | Cruciferae |
| *Fragaria x ananassa* | Rosaceae |
| *Gossypium hirsutum* | Malvaceae |
| *Malus domestica* (apple) | Rosaceae |
| *Medicago sativa* | Fabaceae |
| *Pyrus* sp. | Rosaceae |

Table 9.

TABLE 10

Cabbage Looper (*Trichoplusia ni*)

| Plant name | Family |
| --- | --- |
| *Apium graveolens* var. *dulce* | Umbelliferae |
| *Brassica napus* | Cruciferae |
| *Brassica oleracea* | Cruciferae |
| *Brassica oleracea* var. *acephala* | Cruciferae |
| *Cakile maritima* | Cruciferae |
| *Calendula* sp. | Asteraceae |
| *Chrysanthemum indicum* | Asteraceae |
| *Cucumis sativus* | Cucurbitaceae |
| *Encelia farinosa* A. Gray | Compositae |
| *Erodium cicutarium* | Geraniaceae |
| *Gossypium hirsutum* | Malvaceae |
| *Heliotropium curassavicum* | Boraginaceae |
| *Heterotheca subaxillaris* (*Lam.*) *Britt.* | Compositae |
| *Hieracium* spp. | Compositae |
| *Lactuca sativa* | Compositae |
| *Lactuca serriola* | Compositae |
| *Solanum lycopersicum* | Solanaceae |
| *Malva parviflora* | Malvaceae |
| *Medicago sativa* | Fabaceae |
| *Nicotiana glauca* | Solanaceae |
| *Pisum sativum* | Fabaceae |
| *Polanisia trachysperma* Torr. & A. Gray | Capparidaceae |
| *Portulaca oleraceae* L. | Portulacaceae |
| *Ricinus communis* | Euphorbiaceae |
| *Sisymbrium irio* | Cruciferae |
| *Solanum nigrum* | Solanaceae |
| *Solanum tuberosum* | Solanaceae |
| *Urtica* spp. | Urticaceae |

Table 10.

TABLE 11

Two spotted spider mite

| Plant name | Family |
| --- | --- |
| *Abelmoschus esculentus* (okra) | Malvaceae |
| *Achillea millefolium* (yarrow) | Asteraceae |
| *Actinidia chinensis* (Chinese gooseberry) | Actinidiaceae |
| *Ageratum conyzoides* (billy goat weed) | Asteraceae |
| *Ageratum houstonianum* (Blue billygoatweed) | Asteraceae |
| *Allium cepa* (onion) | Liliaceae |
| *Allium sativum* (garlic) | Liliaceae |
| *Arachis hypogaea* (groundnut) | Fabaceae |
| *Arracacia xanthorrhiza* (arracacha) | Apiaceae |
| *Asparagus officinalis* (asparagus) | Liliaceae |
| *Averrhoa carambola* (carambola) | Oxalidaceae |
| *Beta vulgaris* (beetroot) | Chenopodiaceae |
| *Callistephus chinensis* (China aster) | Asteraceae |
| *Camellia sinensis* (tea) | Theaceae |
| *Capsicum* (Peppers) | Solanaceae |
| *Capsicum annuum* (bell pepper) | Solanaceae |
| *Carica papaya* (pawpaw) | Caricaceae |
| *Catharanthus roseus* (Madagascar periwinkle) | Apocynaceae |
| *Chromolaena odorata* (Siam weed) | Asteraceae |
| *Chrysanthemum* (daisy) | Asteraceae |
| *Chrysanthemum indicum* (chrysanthemum) | Asteraceae |
| *Citrullus lanatus* (watermelon) | Cucurbitaceae |
| *Citrus* | Rutaceae |
| *Citrus limon* (lemon) | Rutaceae |
| *Citrus sinensis* (navel orange) | Rutaceae |
| *Convolvulus arvensis* (bindweed) | Convolvulaceae |
| *Corylus* | Betulaceae |
| *Cucumis melo* (melon) | Cucurbitaceae |
| *Cucumis sativus* (cucumber) | Cucurbitaceae |
| *Cucurbita moschata* (pumpkin) | Cucurbitaceae |
| *Cucurbita pepo* (marrow) | Cucurbitaceae |
| *Cucurbitaceae* (cucurbits) | Cucurbitaceae |
| *Cymbidium* | Orchidaceae |
| *Dahlia pinnata* (garden dahlia) | Asteraceae |
| *Dianthus caryophyllus* (carnation) | Caryophyllaceae |
| *Diospyros* (malabar ebony) | Ebenaceae |
| *Elettaria cardamomum* (cardamom) | Zingiberaceae |
| *Enterolobium cyclocarpum* (ear pod tree) | Fabaceae |
| *Euonymus alatus* (winged spindle) | Salacia |
| *Euphorbia pulcherrima* (poinsettia) | Euphorbiaceae |
| *Fabaceae* (leguminous plants) | Fabaceae |
| *Ficus carica* (common fig) | Moraceae |
| *Fragaria* (strawberry) | Rosaceae |
| *Fragaria ananassa* (strawberry) | Rosaceae |
| *Freesia* | Iridaceae |
| fruits | |
| *Gerbera* (Barbeton daisy) | Asteraceae |
| *Gerbera jamesonii* (African daisy) | Asteraceae |
| *Glycine max* (soyabean) | Fabaceae |
| *Gossypium* (cotton) | Malvaceae |
| *Gypsophila* (baby's breath) | Caryophyllaceae |
| *Hedera helix* (ivy) | Araliaceae |
| *Humulus lupulus* (hop) | Cannabaceae |
| *Ilex crenata* (Japanese holly) | Aquifoliaceae |
| *Impatiens* (balsam) | Balsaminaceae |
| *Ipomoea batatas* (sweet potato) | Convolvulaceae |
| *Lactuca sativa* (lettuce) | Asteraceae |
| *Malus domestica* (apple) | Rosaceae |
| *Manihot esculenta* (cassava) | Euphorbiaceae |
| *Medicago sativa* (lucerne) | Fabaceae |
| *Mentha* (mints) | Lamiaceae |
| *Nicatiana tabacum* (tobacco) | Solanaceae |
| *Orchidaceae* (orchids) | Orchidaceae |
| *Oryza sativa* (rice) | Poaceae |
| *Papaver orientale* (Oriental poppy) | Papaveraceae |
| *Pelargonium* (pelargoniums) | Geraniaceae |
| *Phaseolus* (beans) | Fabaceae |
| *Phaseolus vulgaris* (common bean) | Fabaceae |
| *Phoenix dactylifera* (date-palm) | Arecaceae |
| *Prunus avium* (sweetcherry) | Rosaceae |
| *Prunus cerasus* (sour cherry) | Rosaceae |
| *Prunus domestica* (plum) | Rosaceae |
| *Prunus dulcis* (almond) | Rosaceae |
| *Prunus persica* (peach) | Rosaceae |
| *Prunus salicina* (Japanese plum) | Rosaceae |
| *Pueraria montana* var. *lobata* (kudzu) | Fabaceae |
| *Pyrus communis* (European pear) | Rosaceae |
| *Rhododendron* (Azalea) | Ericaceae |
| *Ribes nigrum* (blackcurrant) | Grossulariaceae |
| *Ribes rubrum* (red currant) | Grossulariaceae |
| *Ricinus communis* (castor bean) | Euphorbiaceae |
| *Rosa* (roses) | Rosaceae |
| *Rosa chinensis* (China rose) | Rosaceae |
| *Rubus idaeus* (raspberry) | Rosaceae |
| *Rubus loganobaccus* (loganberry) | Rosaceae |
| *Salvia splendens* (scarlet sage) | Lamiaceae |
| *Sechium edule* (chayote) | Cucurbitaceae |
| *Sesamum indicum* (sesame) | Pedaliaceae |
| *Solanum lycopersicum* (tomato) | Solanaceae |
| *Solanum melongena* (aubergine) | Solanaceae |

TABLE 11-continued

Two spotted spider mite

| Plant name | Family |
| --- | --- |
| Sorghum bicolor (sorghum) | Poaceae |
| Stachys arvensis (staggerweed) | Lamiaceae |
| Terminalia catappa (Singapore almond) | Combretaceae |
| Tilia cordata (small-leaf lime) | Tiliaceae |
| Trifolium repens (white clover) | Fabaceae |
| Trifolium vesiculosum (Arrowleaf clover) | Fabaceae |
| Vicia faba (faba bean) | Fabaceae |
| Vicia sativa (common vetch) | Fabaceae |
| Vigna angularis (adzuki bean) | Fabaceae |
| Vigna radiata (mung bean) | Fabaceae |
| Vigna unguiculata (cowpea) | Fabaceae |
| Viola odorata (English violet) | Violaceae |
| Vitis vinifera (grapevine) | Vitaceae |
| Withania somnifera (poisonous gooseberry) | Solanaceae |
| Zantedeschia aethiopica (calla lily) | Araceae |
| Zea mays (maize) | Poaceae |
| Zea mays subsp. mays (sweetcorn) | Poaceae |

Table 11.

Compositions-of-Matter

The biologically pure bacterial isolate of some embodiments of the invention, the biologically pure modified bacterial isolate of some embodiments of the invention, and/or the modified bacterial isolate resultant of the method of some embodiments of the invention, the lysate or whole cell broth of some embodiments of the invention, the isolated polynucleotide of some embodiments of the invention, the isolated polypeptide of some embodiments of the invention and/or the nucleic acid construct of some embodiments of the invention can be administered to the plant per se, or in a composition-of-matter where it can be mixed with additional material(s).

Herein the term "active ingredient" refers to the biologically pure bacterial isolate of some embodiments of the invention, the biologically pure modified bacterial isolate of some embodiments of the invention, the modified bacterial isolate resultant of the method of some embodiments of the invention, the lysate or whole cell broth of some embodiments of the invention, the isolated polynucleotide of some embodiments of the invention, the polypeptide of some embodiments of the invention and/or the nucleic acid construct of some embodiments of the invention accountable for the biological effect in inhibiting the activity and/or killing the insect of some embodiments of the invention.

According to some embodiments of the invention, the biologically pure bacterial isolate of some embodiments of the invention, and/or a lysate or whole cell broth thereof, and/or the polypeptide of some embodiments of the invention is also capable of inhibiting a nematode.

According to some embodiments of the invention, the nematodes include parasitic nematodes such as root-knot, cyst, and lesion nematodes, including Heterodera spp., Meloidogyne spp., and Globodera spp.; particularly members of the cyst nematodes, including, but not limited to, Heterodera glycines (soybean cyst nematode); Heterodera schachtii (beet cyst nematode); Heterodera avenae (cereal cyst nematode); and Globodera rostochiensis and Globodera pailida (potato cyst nematodes). Lesion nematodes include Pratylenchus spp.

According to an aspect of some embodiments of the invention there is provided a composition-of-matter comprising the biologically pure bacterial isolate of some embodiments of the invention, the biologically pure modified bacterial isolate of some embodiments of the invention, and/or the modified bacterial isolate resultant of the method of some embodiments of the invention.

According to some embodiments of the invention, the biologically pure bacterial isolate of some embodiments of the invention, the biologically pure modified bacterial isolate of some embodiments of the invention, and/or the modified bacterial isolate resultant of the method of some embodiments of the invention is comprised in the composition-of-matter at about $10^5$ CFU/gram to about $10^{12}$ CFU/gram.

According to an aspect of some embodiments of the invention there is provided a composition-of-matter comprising the lysate or whole cell broth of some embodiments of the invention.

According to an aspect of some embodiments of the invention there is provided a composition-of-matter comprising the isolated polypeptide of some embodiments of the invention.

According to an aspect of some embodiments of the invention there is provided a composition-of-matter comprising the isolated polynucleotide of some embodiments of the invention or the nucleic acid construct of some embodiments of the invention.

According to an aspect of some embodiments of the invention there is provided a composition-of-matter comprising a combination of at least two distinct biologically pure bacterial isolates of some embodiments of the invention, and/or at least two distinct lysates or whole cell broth of some embodiments of the invention.

According to an aspect of some embodiments of the invention there is provided a composition-of-matter comprising at least two distinct isolated polypeptides of some embodiments of the invention, at least two distinct isolated polynucleotides of some embodiments of the invention, and/or at least two distinct nucleic acid constructs of some embodiments of the invention.

According to some embodiments of the invention, the composition-of-matter further comprising at least one additional biologically pure bacterial isolate and/or at least one lysate or whole cell broth thereof prepared from the at least one additional biologically pure bacterial isolate.

According to some embodiments of the invention, the composition-of-matter further comprising at least one additional polypeptide, at least one additional polynucleotide encoding the at least one additional polypeptide, and/or at least one additional nucleic acid construct encoding the at least one additional polypeptide.

According to some embodiments of the invention, the at least one additional biologically pure bacterial isolate or the at least one additional polypeptide is capable of killing or inhibiting the development of an insect.

According to some embodiments of the invention, the at least one additional biologically pure bacterial isolate or the at least one additional polypeptide is not capable of killing or inhibiting the development of an insect.

According to some embodiments of the invention, any of the composition-of-matter can further comprise a chemical or biological insecticide or other microorganism and/or pesticide (e.g., nematicide, fungicide, insecticide, herbicide). The microorganism can include, but is not limited to, an agent derived from Bacillus sp. (e.g., B. firmus, B. thuringiensis, B. pumilus, B. licheniformis, B. amyloliquefaciens, B. subtilis), Paecilomyces sp. (P. lilacinus), Pasteuria sp. (P. penetrans), Pseudomonas sp., Brevabacillus sp., Lecanicillium sp., Ampelomyces sp., Pseudozyma sp., Streptomyces sp. (S. bikiniensis, S. costaricanus, S. avermitilis), Trichoderma sp., Gliocladium sp., avermectin,

*Myrothecium* sp., *Paecilomyces* spp., *Sphingobacterium* sp., *Arthrobotrys* sp., *Chlorosplrnium* sp, *Neobulgaria* sp, *Daldinia* sp, *Aspergillus* sp, *Chaetomium* sp, *Lysobacter* sp, *Lachnum papyraceum*, *Verticillium suchlasporium*, *Arthrobotrys oligospora*, *Pochonia chlamydosporia* (synonym: *Verticillium chlamydosporium*), *Hirsutella minnesotensis*, *Hirsutella rhossiliensis*, *Pleurotus ostreatus*, *Omphalotus olearius*, *Lampteromyces japonicas*, *Brevudimonas* sp., and *Muscodor* sp. The pesticide can be a natural oil, oil product or chemical pesticide. In particular, the agent can be a natural oil or oil-product having nematicidal, fungicidal and/or insecticidal activity (e.g., paraffinic oil, tea tree oil, lemongrass oil, clove oil, cinnamon oil, citrus oil (including but not limited to bitter orange, orange, lemon) rosemary oil, pyrethrum, allspice, bergamot, blue gum, camomile, citronella, common jasmine, common juniper, common lavender, common myrrh, field mint, freesia, gray santolina, herb hyssop, holy basil, incense tree, jasmine, lavender, marigold, mint, peppermint, pot marigold, spearmint, ylang-ylang tree, and saponins. The chemical pesticide can be a single site anti-fungal agent which can include but is not limited to benzimidazole, a demethylation inhibitor (DMI) (e.g., imidazole, piperazine, pyrimidine, triazole), morpholine, hydroxypyrimidine, anilinopyrimidine, phosphorothiolate, quinone outside inhibitor, quinoline, dicarboximide, carboximide, phenylamide, anilinopyrimidine, phenylpyrrole, aromatic hydrocarbon, cinnamic acid, hydroxyanilide, antibiotic, polyoxin, acylamine, phthalimide, benzenoid (xylylalanine), a demethylation inhibitor selected from the group consisting of imidazole, piperazine, pyrimidine and triazole (e.g., bitertanol, myclobutanil, penconazole, propiconazole, triadimefon, bromuconazole, cyproconazole, diniconazole, fenbuconazole, hexaconazole, tebuconazole, tetraconazole), myclobutanil, and a quinone outside inhibitor (e.g., strobilurin). The strobilurin can include but is not limited to azoxystrobin, kresoxim-methyl or trifloxystrobin. In yet another particular embodiment, the anti-fungal agent is a quinone, e.g., quinoxyfen(5,7-dichloro-4-quinolyl 4-fluorophenyl ether). The anti-fungal agent can also be derived from a *Reynoutria* extract. The chemical pesticide can also be a multi-site non-inorganic, chemical fungicide. For example, the chemical fungicide can be chloronitrile, quinoxaline, sulphamide, phosphonate, phosphite, dithiocarbamate, chloralkythios, phenylpyridinamine, or cyano-acetamide oxime. Nematicides can include, but are not limited to, avermectin nematicides (e.g., abamectin); botanical nematicides (e.g., carvacrol); carbamate nematicides (e.g., benomyl carbofuran, carbosulfan, cloethocarb); oxime carbamate nematicides (e.g., alanycarb, aldicarb aldoxycarb, oxamyl tirpate); fumigant nematicides (e.g., carbon disulfide, cyanogen, 1,2-dichloropropane, 1,3-dichloropropene, dithioether, methyl bromide, methyl iodide, sodium tetrathiocarbonate); organophosphorus nematicides, which includes, but are not limited to, organophosphate nematicides (e.g., diamidafos, fenamiphos, fosthietan, phosphamidon); organothiophosphate nematicides (e.g., cadusafos, chlorpyrifos, dichlofenthion dimethoate ethoprophos, fensulfothion, fosthiazate, heterophos, isamidofos, isazofos, phorate, phosphocarb, terbufos, thionazin, triazophos); phosphonothioate nematicides (e.g., imicyafos, mecarphon); and other nematicides (e.g., acetoprole, benclothiaz, chloropicrin, dazomet, DBCP, DCIP, fluensulfone, furfural, metam, methyl isothiocyanate, xylenols, spirotetramat).

According to some embodiments of the invention, any compositions disclosed herein can also be used in combination with other growth promoting agents such as synthetic or organic fertilizers (e.g., di-ammonium phosphate in either granular or liquid form), compost teas, seaweed extracts, plant growth hormones such as IAA (indole acetic acid) used in a rooting hormone treatment for transplants either alone or in combination with plant growth regulators such as IBA (indole butyric acid) and NAA (naphthalene acetic acid), and growth promoting microbes, such as *Bacillus* spp., *Pseudomonas*, *Rhizobia*, and *Trichoderma* spp.

According to an aspect of some embodiments of the invention there is provided a composition-of-matter comprising:

(a) a whole cell broth collected from fermentation of the biologically pure bacterial isolate of some embodiments of the invention, the biologically pure modified bacterial isolate of some embodiments of the invention, or the modified bacterial isolate resultant of some embodiments of the invention, wherein the fermentation has an insect killing or inhibitory activity; and (b) at least one of a carrier, a stabilizer, a diluent, a surfactant, a mineral or an adjuvant.

According to some embodiments of the invention, the composition-of-matter is in a dehydrated form.

According to some embodiments of the invention, the composition-of-matter is in lyophilized form.

It should be noted that the composition-of-matter of some embodiments of the invention which includes the active ingredient, can further include a carrier (e.g., an inert carrier), and if necessary, also a surfactant and/or another auxiliary for formulation, such as an extender, by formulating the mixture into oil formulation, emulsifiable concentrate, flowable formulation, wettable powder, water dispersible granules, powder, granules, or the like. The formulation, which is used alone or by adding another inert component, can be used as a pesticide (e.g., against insects).

The composition-of-matter of some embodiments of the invention may also contain further ingredients, such as stabilizers, antifoams, viscosity regulators, binders, tackifiers as well as fertilizers or other active ingredients in order to obtain special effects.

According to some embodiments of the invention, the composition-of-matter further comprising at least one agent selected from the group consisting of: a carrier, a stabilizer, a diluent, a surfactant, a mineral and an adjuvant.

Suitable organic solvents include all polar and non-polar organic solvents usually employed for formulation purposes. Preferable the solvents are selected from ketones, methyl-isobutyl-ketone and cyclohexanone, amides, dimethyl formamide and alkanecarboxylic acid amides, N,N-dimethyl decaneamide and N,N-dimethyl octanamide, furthermore cyclic solvents, N-methyl-pyrrolidone, N-octylpyrrolidone, N-dodecyl-pyrrolidone, N-octyl-caprolactame, N-dodecyl-caprolactame and butyrolactone, furthermore strong polar solvents, dimethylsulfoxide, and aromatic hydrocarbons, xylol, Solvesso™ mineral oils, white spirit, petroleum, alkyl benzenes and spindle oil, also esters, propyleneglycol-monomethylether acetate, adipic acid dibutylester, acetic acid hexylester, acetic acid heptylester, citric acid tri-n-butylester and phthalic acid di-n-butylester, and also alkohols, benzyl alcohol and 1-methoxy-2-propanol.

According to some embodiments of the invention, a carrier is a natural or synthetic, organic or inorganic substance with which the active ingredients are mixed or combined for better applicability, in particular for application to plants or plant parts or seed. The carrier, which may be solid or liquid, is generally inert and should be suitable for use in agriculture.

Useful solid or liquid carriers include: for example ammonium salts and natural rock dusts, such as kaolins, clays, talc, chalk, quartz, attapulgite, montmorillonite or diatomaceous earth, and synthetic rock dusts, such as finely divided silica, alumina and natural or synthetic silicates, resins, waxes, solid fertilizers, water, alcohols, especially butanol, organic solvents, mineral and vegetable oils, and derivatives thereof. Mixtures of such carriers can likewise be used.

Suitable solid filler and carrier include inorganic particles, carbonates, silikates, sulphates and oxides with an average particle size of between 0.005 and 20 µm, preferably of between 0.02 to 10 µm, for example ammonium sulphate, ammonium phosphate, urea, calcium carbonate, calcium sulphate, magnesium sulphate, magnesium oxide, aluminium oxide, silicium dioxide, so-called fine-particle silica, silica gels, natural or synthetic silicates, and alumosilicates and plant products like cereal flour, wood powder/sawdust and cellulose powder.

Useful solid carriers for granules include: for example crushed and fractionated natural rocks such as calcite, marble, pumice, sepiolite, dolomite, and synthetic granules of inorganic and organic meals, and also granules of organic material such as sawdust, coconut shells, maize cobs and tobacco stalks.

Useful liquefied gaseous extenders or carriers are those liquids which are gaseous at standard temperature and under standard pressure, for example aerosol propellants such as halohydrocarbons, and also butune, propane, nitrogen and carbon dioxide.

In the formulations, it is possible to use tackifiers such as carboxymethylcellulose, and natural and synthetic polymers in the form of powders, granules or latices, such as gum arabic, polyvinyl alcohol and polyvinyl acetate, or else natural phospholipids, such as cephalins and lecithins, and synthetic phospholipids. Further additives may be mineral and vegetable oils.

If the extender used is water, it is also possible to employ, for example, organic solvents as auxiliary solvents. Useful liquid solvents are essentially: aromatics such as xylene, toluene or alkylnaphthalenes, chlorinated aromatics and chlorinated aliphatic hydrocarbons such as chlorobenzenes, chloroethylenes or dichloromethane, aliphatic hydrocarbons such as cyclohexane or paraffins, for example mineral oil fractions, mineral and vegetable oils, alcohols such as butanol or glycol and their ethers and esters, ketones such as acetone, methyl ethyl ketone, methyl isobutyl ketone or cyclohexanone, strongly polar solvents such as dimethylformamide and dimethyl sulphoxide, and also water.

Useful surfactants are emulsifiers and/or foam formers, dispersants or wetting agents having ionic or nonionic properties, or mixtures of these surfactants. Examples of these are salts of polyacrylic acid, salts of lignosulphonic acid, salts of phenolsulphonic acid or naphthalenesulphonic acid, polycondensates of ethylene oxide with fatty alcohols or with fatty acids or with fatty amines, substituted phenols (preferably alkylphenols or arylphenols), salts of sulphosuccinic esters, taurine derivatives (preferably alkyl taurates), phosphoric esters of polyethoxylated alcohols or phenols, fatty esters of polyols, and derivatives of the compounds containing sulphates, sulphonates and phosphates, for example alkylaryl polyglycol ethers, alkylsulphonates, alkylsulphates, arylsulphonates, protein hydrolysates, lignosulphite waste liquors and methylcellulose. The presence of a surfactant is necessary if one of the active ingredients and/or one of the inert carriers is insoluble in water and when application is effected in water. The proportion of surfactants is between 5 and 40 percent by weight of the composition-of-matter of some embodiments of the invention.

Suitable surfactants (adjuvants, emulsifiers, dispersants, protective colloids, wetting agent and adhesive) include all common ionic and non-ionic substances, for example ethoxylated nonylphenols, polyalkyl glycolether of linear or branched alcohols, reaction products of alkyl phenols with ethylene oxide and/or propylene oxide, reaction products of fatty acid amines with ethylene oxide and/or propylene oxide, furthermore fattic acid esters, alkyl sulfonates, alkyl sulphates, alkyl ethersulphates, alkyl etherphosphates, arylsulphate, ethoxylated arylalkylphenols, tristyryl-phenol-ethoxylates, furthermore ethoxylated and propoxylated arylalkylphenols like sulphated or phosphated arylalkylphenol-ethoxylates and -ethoxy- and -propoxylates. Further examples are natural and synthetic, water soluble polymers, lignosulphonates, gelatine, gum arabic, phospholipides, starch, hydrophobic modified starch and cellulose derivatives, in particular cellulose ester and cellulose ether, further polyvinyl alcohol, polyvinyl acetate, polyvinyl pyrrolidone, polyacrylic acid, polymethacrylic acid and co-polymerisates of (meth)acrylic acid and (meth)acrylic acid esters, and further co-polymerisates of methacrylic acid and methacrylic acid esters which are neutralized with alkalimetal hydroxide and also condensation products of optionally substituted naphthalene sulfonic acid salts with formaldehyde.

It is possible to use dyes such as inorganic pigments, for example iron oxide, titanium oxide and Prussian Blue, and organic dyes such as alizarin dyes, azo dyes and metal phthalocyanine dyes, and trace nutrients such as salts of iron, manganese, boron, copper, cobalt, molybdenum and zinc.

Antifoams which may be present in the formulations include e.g. silicone emulsions, longchain alcohols, fatty acids and their salts as well as fluoroorganic substances and mixtures thereof.

Examples of thickeners are polysaccharides, xanthan gum or veegum, silicates, attapulgite, bentonite as well as fine-particle silica.

If appropriate, it is also possible for other additional components to be present, for example protective colloids, binders, adhesives, thickeners, thixotropic substances, penetrants, stabilizers, sequestrants, complexing agents. In general, the active ingredients can be combined with any solid or liquid additive commonly used for formulation purposes.

Solvents, carriers, surfactants, surface active compounds, etc that are customarily employed in the art of formulation and can be suitably used within the present invention are disclosed, for example, in WO 96/10083.

The composition-of-matter of some embodiments of the invention can be used as such or, depending on their particular physical and/or chemical properties, in the form of their formulations or the use forms prepared therefrom, such as aerosols, capsule suspensions, cold-fogging concentrates, warm-fogging concentrates, encapsulated granules, fine granules, flowable concentrates for the treatment of seed, ready-to-use solutions, dustable powders, emulsifiable concentrates, oil-in-water emulsions, water-in-oil emulsions, macrogranules, microgranules, oildispersible powders, oil-miscible flowable concentrates, oil-miscible liquids, gas (under pressure), gas generating product, foams, pastes, pesticide coated seed, suspension concentrates, suspoemulsion concentrates, soluble concentrates, suspensions, wettable powders, soluble powders, dusts and granules, water-soluble and water-dispersible granules or tablets, water-soluble and water-dispersible powders for the treatment of seed, wettable powders, natural products and synthetic substances impregnated with active ingredient, and also microencapsulations in polymeric substances and in coating materials for seed, and also ULV cold-fogging and warm-fogging formulations.

According to some embodiments of the invention, the composition-of-matter of some embodiments of the invention is compatible with most other commonly used agricultural spray materials.

According to some embodiments of the invention, the composition-of-matter of some embodiments of the invention may be administered as a dust, a suspension, a wettable powder or in any other material form suitable for agricultural application.

The composition-of-matter of some embodiments of the invention, formulations and/or mixtures thereof generally contain between 0.05 and 99% by weight, 0.01 and 98% by weight, preferably between 0.1 and 95% by weight, more preferably between 0.5 and 90% of active ingredient, most preferably between 10 and 70% by weight. For special applications, e.g. for protection of wood and derived timber products the composition-of-matter of some embodiments of the invention, formulations and/or mixtures thereof generally contain between 0.0001 and 95% by weight, preferably 0.001 to 60% by weight of active ingredient.

The contents of active ingredient in the application forms prepared from the formulations may vary in a broad range. The concentration of the active ingredients in the application forms is generally between 0.000001 to 95% by weight, preferably between 0.0001 and 2% by weight.

The composition-of-matter of some embodiments of the invention may include not only formulations which are already ready for use and can be applied with a suitable apparatus to the plant or the seed, but also commercial concentrates which have to be diluted with water prior to use. Whereas commercial products are preferably formulated as concentrates, the end user will normally employ dilute formulations of substantially lower concentration, such as dilution in water and subsequent spraying of the resulting spray liquor, or application after dilution in oil.

The composition-of-matter of some embodiments of the invention may also contain a further biologically active compound selected from fertilizers, micronutrient donors, plant growth preparations, herbicides, insecticides, fungicides, bactericides, nematicides, molluscicides, attractants, sterilants, acaricides, growth regulators, fertilizers, safeners, chemicals and/or semiochemicals and mixtures thereof, without loss of potency.

The composition-of-matter may comprise from 0.1 to 99% by weight of the active ingredient; from 1 to 99.9% by weight of a solid or liquid adjuvant, and from 0 to 25% by weight of a surfactant.

The formulations mentioned can be prepared in a manner known per se, for example by mixing the active ingredients with at least one customary extender, solvent or diluent, adjuvant, emulsifier, dispersant, and/or binder or fixative, wetting agent, water repellent, if appropriate desiccants and UV stabilizers and, if appropriate, dyes and pigments, antifoams, preservatives, inorganic and organic thickeners, adhesives, gibberellins and also further processing auxiliaries and also water. Depending on the formulation type to be prepared further processing steps are necessary, e.g. wet grinding, dry grinding and granulation.

According to some embodiments of the invention, the treatment of the plants and plant parts with the composition-of-matter of some embodiments of the invention, formulations and/or mixtures thereof is effected directly or by action on their surroundings, habitat or storage space by the customary treatment methods, for example by dipping, spraying, atomizing, irrigating, evaporating, dusting, fogging, broadcasting, foaming, painting, spreading-on, watering (drenching), drip irrigating and, in the case of propagation material, especially in the case of seeds, also by dry seed treatment, wet seed treatment, slurry treatment, incrustation, coating with one or more coats, etc. It is also possible to deploy the mixtures or compositions by the ultra-low volume method or to inject the mixtures or compositions preparation or the mixtures or compositions itself into the soil.

According to some embodiments of the invention, the composition-of-matter of some embodiments of the invention may be applied to the crop area or plant to be treated, simultaneously or in succession, with further biologically active compounds. These compounds may be both fertilizers or micronutrient donors or other preparations that influence plant growth. They may also be selective herbicides, insecticides, fungicides, bactericides, nematicides, molluscicides or mixtures of several of these preparations, if desired together with further carriers, surfactants or application-promoting adjuvants customarily employed in the art of formulation. Suitable carriers and adjuvants can be solid or liquid and correspond to the substances ordinarily employed in formulation technology, natural or regenerated mineral substances, solvents, dispersants, wetting agents, tackifiers, binders or fertilizers. The formulations of the composition-of-matter of some embodiments of the invention, and/or with other active ingredients, and, where appropriate, a solid or liquid adjuvant, are prepared in known manner, e.g., by homogeneously mixing and/or grinding the active ingredients with extenders, solvents, solid carriers, and in some cases surface-active compounds (surfactants).

According to some embodiments of the invention, the composition-of-matter of some embodiments of the invention, being in a pressurized form, a pressurizable form, a dry form, a liquid form, and/or a sprayable form.

According to some embodiments of the invention, the composition-of-matter of some embodiments of the invention, comprised in a container or a packaging material.

According to an aspect of some embodiments of the invention there is provided a packaging material packaging the biologically pure bacterial isolate of some embodiments of the invention, the biologically pure modified bacterial isolate of some embodiments of the invention, the modified bacterial isolate resultant of the method of some embodiments of the invention, the isolated polypeptide of some embodiments of the invention, or the composition-of-matter of some embodiments of the invention.

According to an aspect of some embodiments of the invention, there is provided a container adapted for a watering system of a plant field comprising the biologically pure bacterial isolate of some embodiments of the invention, the biologically pure modified bacterial isolate of some embodiments of the invention, the modified bacterial isolate resultant of the method of some embodiments of the invention, the isolated polypeptide of some embodiments of the invention, or the composition-of-matter of some embodiments of the invention.

According to some embodiments of the invention, the watering system is automatically operable.

According to some embodiments of the invention, the watering system is manually operable.

According to some embodiments of the invention, the container comprises a puncturing device for releasing comprising the biologically pure bacterial isolate of some embodiments of the invention, the biologically pure modified bacterial isolate of some embodiments of the invention, the modified bacterial isolate resultant of the method of some embodiments of the invention, the isolated polypeptide of some embodiments of the invention, or the composition-of-matter of some embodiments of the invention through the watering system into the plant field.

According to some embodiments of the invention, the container comprises a resealable membrane configured for multiple releases of the biologically pure bacterial isolate of some embodiments of the invention, the biologically pure modified bacterial isolate of some embodiments of the invention, the modified bacterial isolate resultant of the method of some embodiments of the invention, the isolated polypeptide of some embodiments of the invention, or the composition-of-matter of some embodiments of the invention through the watering system into the plant field.

According to an aspect of some embodiments of the invention there is provided a kit comprising the composition-of-matter of some embodiments of the invention, and instructions for use in killing or inhibiting the development of an insect.

Compositions of some embodiments of the invention may, if desired, be presented in a pack or dispenser device, such as a United States Environmental Protection Agency (U.S EPA) approved kit, which may contain one or more unit dosage forms containing the active ingredient. The pack may, for example, comprise metal or plastic foil, such as a blister pack. The pack or dispenser device may be accompanied by instructions for administration. The pack or dispenser may also be accommodated by a notice associated with the container in a form prescribed by a governmental agency regulating the manufacture, use or sale of pharmaceuticals, which notice is reflective of approval by the agency of the form of the compositions or human or veterinary administration. Such notice, for example, may be of labeling approved by the United States Environmental Protection Agency (U.S EPA) for application on plants (e.g., crops).

It should be noted that the biologically pure bacterial isolate of some embodiments of the invention, the biologically pure modified bacterial isolate of some embodiments of the invention, the modified bacterial isolate resultant of the method of some embodiments of the invention, the isolated polypeptide of some embodiments of the invention, or the composition-of-matter of some embodiments of the invention can be applied to a plant seed as part of a seed coating.

According to an aspect of some embodiments of the invention there is provided a coated seed comprising a plant seed and a coating on the plant seed, wherein the coating comprises the biologically pure bacterial isolate of some embodiments of the invention, the biologically pure modified bacterial isolate of some embodiments of the invention, the modified bacterial isolate resultant of the method of some embodiments of the invention, the isolated polypeptide of some embodiments of the invention, or the composition-of-matter of some embodiments of the invention.

As used herein the phrase "seed coating" refers to a coating or a matrix formed on at least part of the seed.

According to some embodiments of the invention, the seed coating or matrix comprising at least one biologically pure bacterial isolate of some embodiments of the invention and/or a lysate or whole cell broth thereof, and/or the composition-of-matter of some embodiments of the invention.

Optional compounds or agents may be included in the seed coating to facilitate the seed coating process and/or to facilitate the disintegration/releasing of the at least one biologically pure bacterial isolate of some embodiments of the invention, the lysate or whole cell broth thereof or the composition-of-matter of some embodiments of the invention from the coating, and/or to prevent excessive dust-off or to add color to the treated seed.

Seed coating includes, alone or in combination, seed buildup, seed encrustment, and seed pelleting operations. Seed coating can be on live or dead seeds.

According to some embodiments of the invention, the biologically pure bacterial isolate is present on a surface of the seed surface at about $10^1$ colony forming unit (CFU)/seed to about $10^{12}$ CFU).

According to some embodiments of the invention, the coated seed is a monocot.

According to some embodiments of the invention, the coated seed is a dicot.

According to some embodiments of the invention, the coating further comprising at least one agent selected from the group consisting of: a wetting agent, a binding agent, an agricultural active agent, and a nutrient.

A wetting agent is a substance that when added to a liquid increases the spreading or penetration power of the liquid by reducing the interfacial tension between the liquid and the surface on which it is spreading.

Wetting agents are generally used during processing and manufacture of agents used in the agricultural industry to increase the rate of wetting of powders in water, to make concentrates for soluble liquids or suspension concentrates; and during mixing of a product with water in a spray tank or other vessel(s) to reduce the wetting time of wettable powders and to improve the penetration of water into water-dispersible granules.

It should be noted that a wetting agent can be added to the composition-of-matter of some embodiments of the invention in order to increase the wettability of the composition-of-matter in a liquid. Additionally or alternatively, the wetting agent can be comprised in the container of some embodiments of the invention or in a seed coating of some embodiments of the invention for increasing wettability of the material contained in the container or in the seed coating in a liquid (e.g., water).

According to some embodiments of the invention, the wetting agent is comprised in a wettable powder, a suspension concentrate, and/or in water-dispersible granule formulation.

According to some embodiments of the invention, the wetting agent is sodium lauryl sulphate, sodium dioctyl sulphosuccinate, alkyl phenol ethoxylates, and/or aliphatic alcohol ethoxylates.

According to some embodiments of the invention, the binding agent (also referred to as "a binder") is an agent selected from the group consisting of molasses, granulated sugar, alginates, karaya gum, jaguar gum, tragacanth gum, polysaccharide gum, mucilage and any combination thereof.

According to some embodiments of the invention, the agricultural active agent can be a herbicide, a plant growth regulator, crop dessicant, fungicide, bacteriocide, insecticide, an agent for improving seed germination or propagation, an agent for improving plant growth, and mixtures thereof.

According to some embodiments of the invention, the coating is in a form of a hydrogel.

Hydrogels are comprised of networks polymer chains that are hydrophilic, in which water is the dispersion medium.

Hydrogels are highly absorbent and can contain over 99.9% water within natural or synthetic polymers. Hydrogel materials also possess a degree of flexibility very similar to natural tissue, due to their significant water content. Environmentally sensitive hydrogels are also known as 'Smart Gels' or 'Intelligent Gels' and these have the ability to sense changes of pH, temperature, or the concentration of metabolite and release the active drug or other incorporated material as result of such a change. As such they are useful as sustained-release drug delivery systems and other uses where water absorption and retention is important.

According to some embodiments of the invention, the coating is comprised of a hydrogel composition comprising a gelatin, wherein the gelatin is comprised of naturally derived proteins and one or more polysaccharides.

According to some embodiments of the invention, the coating composition is bio-degradable.

The biologically pure bacterial isolate of some embodiments of the invention and/or the lysate or whole cell broth thereof, and/or the composition-of-matter of some embodiments of the invention can be formulated as a cell paste, wettable powder, dust, granule, aqueous or oil based liquid product, and the like. Such formulations can also comprise carriers and other agents. The formulations can be used as field inoculants for insecticide control, seed coatings, etc. Thus, biologically pure bacterial isolate of some embodiments of the invention and/or the lysate or whole cell broth thereof, and/or the composition-of-matter of some embodiments of the invention can be used in any manner known in the art, including coating seeds with an effective amount of the biologically pure bacterial isolate of some embodiments of the invention and/or the lysate or whole cell broth thereof, and/or the composition-of-matter of some embodiments of the invention, in furrow application of the biologically pure bacterial isolate of some embodiments of the invention and/or the lysate or whole cell broth thereof, and/or the composition-of-matter of some embodiments of the invention directly into the soil, in foliar application, mixing into a potting mixture, and in post-harvest insecticide control. Such methods are known in the art and are described, for example, in U.S. Pat. No. 5,348,742 and in published European Application EP0472494 A2, both of which are herein incorporated by reference.

As mentioned, the isolated polypeptides and polynucleotides of some embodiments of the invention can be expressed in a plant to thereby increase the resistance of the plant to the insect.

According to an aspect of some embodiments of the invention there is provided a method of increasing a resistance of a plant to an insect, comprising expressing within the plant a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more homologous or identical to an amino acid sequence selected from the group consisting of SEQ ID NOs: 249-495, 632-655 and 656-697, thereby increasing the resistance of the plant to the insect.

According to some embodiments of the invention, the polypeptide is capable of killing or inhibiting the development of the insect.

According to some embodiments of the invention, the polypeptide is expressed from a polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more identical to a polynucleotide selected from the group consisting of SEQ ID NOs: 1-248, and 608-631.

Additionally or alternatively, the isolated polypeptide, the biologically pure bacterial isolates and/or the composition-of-matter of some embodiments of the invention can be applied onto a plant to inhibit and/or killing the insect on the plant (a plant which is already infested by the insect).

According to an aspect of some embodiments of the invention there is provided a method of inhibiting an insect in a plant, the method comprising contacting the plant or a part thereof with the biologically pure bacterial isolate of some embodiments of the invention, the biologically pure modified bacterial isolate of some embodiments of the invention, the modified bacterial isolate resultant of the method of some embodiments of the invention, the lysate or whole cell broth of some embodiments of the invention, the isolated polypeptide of some embodiments of the invention, and/or the composition-of-matter of a some embodiments of the invention, thereby inhibiting the insect in the plant.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

The present invention also envisages expressing a plurality of exogenous polynucleotides in a single host plant to thereby achieve superior effect on insect inhibitory and/or killing activity.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence, which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants.

The regenerated transformed plants can then be cross-bred and resultant progeny selected for superior insect killing and/or inhibitory activity using conventional plant breeding techniques.

The nucleic acid construct of some embodiments of the invention can be expressed in a variety of host cells, such as plants (such as described above), bacterial cells, yeast, mammalian and insect cells.

According to some embodiments of the invention the nucleic acid construct is expressed in a bacterial cell for the production of the isolated polypeptide.

In addition to the elements already described, the expression vector of some embodiments of the invention may typically contain other specialized elements intended to increase the level of expression of cloned nucleic acids or to facilitate the identification of cells that carry the recombinant DNA.

It will be appreciated that the individual elements comprised in the expression vector can be arranged in a variety of configurations. For example, enhancer elements, promoters and the like, and even the polynucleotide sequence(s) encoding the polypeptide of some embodiments of the invention can be arranged in a "head-to-tail" configuration, may be present as an inverted complement, or in a complementary configuration, as an anti-parallel strand. While such variety of configuration is more likely to occur with non-coding elements of the expression vector, alternative configurations of the coding sequence within the expression vector are also envisioned.

Other than containing the necessary elements for the transcription and translation of the inserted coding sequence, the expression construct of some embodiments of the invention can also include sequences engineered to enhance stability, production, purification, yield or toxicity of the expressed peptide. For example, the expression of a fusion protein or a cleavable fusion protein comprising the polypeptide of some embodiments of the invention and a heterologous protein can be engineered. Such a fusion protein can be designed so that the fusion protein can be readily isolated by affinity chromatography; by immobilization on a column specific for the heterologous protein. Where a cleavage site is engineered between the polypeptide of some embodiments of the invention and the heterologous protein, the polypeptide of some embodiments of the invention can be released from the chromatographic column by treatment with an appropriate enzyme or agent that disrupts the cleavage site [e.g., see Booth et al. (1988) Immunol. Lett. 19:65-70; and Gardella et al., (1990) J. Biol. Chem. 265: 15854-15859].

As mentioned hereinabove, a variety of prokaryotic or eukaryotic cells can be used as host-expression systems to express the polypeptides of some embodiments of the invention. These include, but are not limited to, microorganisms, such as bacteria transformed with a recombinant bacteriophage DNA, plasmid DNA or cosmid DNA expression vector containing the coding sequence; yeast transformed with recombinant yeast expression vectors containing the coding sequence; plant cell systems infected with recombinant virus expression vectors (e.g., cauliflower mosaic virus, CaMV; tobacco mosaic virus, TMV) or transformed with recombinant plasmid expression vectors, such as Ti plasmid, containing the coding sequence. Mammalian expression systems can also be used to express the polypeptides of some embodiments of the invention.

Examples of bacterial constructs include the pET series of E. coli expression vectors [Studier et al. (1990) Methods in Enzymol. 185:60-89).

In yeast, a number of vectors containing constitutive or inducible promoters can be used, as disclosed in U.S. Pat. No. 5,932,447. Alternatively, vectors can be used which promote integration of foreign DNA sequences into the yeast chromosome.

Other expression systems such as insects and mammalian host cell systems which are well known in the art and are further described hereinbelow can also be used by some embodiments of the invention.

Recovery of the recombinant polypeptide is effected following an appropriate time in culture. The phrase "recovering the recombinant polypeptide" refers to collecting the whole fermentation medium containing the polypeptide and need not imply additional steps of separation or purification. Not withstanding the above, polypeptides of some embodiments of the invention can be purified using a variety of standard protein purification techniques, such as, but not limited to, affinity chromatography, ion exchange chromatography, filtration, electrophoresis, hydrophobic interaction chromatography, gel filtration chromatography, reverse phase chromatography, concanavalin A chromatography, chromatofocusing and differential solubilization.

It should be noted that while some of the isolated polypeptides of the invention originate from bacterial cells, close orthologues of such polypeptide sequences can be identified by known bioinformatics methods in plants and can be further over-expressed in a plant by means of recombinant DNA techniques (e.g., as described above) and/or by genome editing (e.g., as described hereinunder).

According to some embodiments of the invention, over-expression of the polypeptide of the invention is achieved by means of genome editing.

Genome editing is a reverse genetics method which uses artificially engineered nucleases to cut and create specific double-stranded breaks at a desired location(s) in the genome, which are then repaired by cellular endogenous processes such as, homology directed repair (HDR) and non-homologous end-joining (NFfEJ). NFfEJ directly joins the DNA ends in a double-stranded break, while HDR utilizes a homologous sequence as a template for regenerating the missing DNA sequence at the break point. In order to introduce specific nucleotide modifications to the genomic DNA, a DNA repair template containing the desired sequence must be present during HDR. Genome editing cannot be performed using traditional restriction endonucleases since most restriction enzymes recognize a few base pairs on the DNA as their target and the probability is very high that the recognized base pair combination will be found in many locations across the genome resulting in multiple cuts not limited to a desired location. To overcome this challenge and create site-specific single- or double-stranded breaks, several distinct classes of nucleases have been discovered and bioengineered to date. These include the meganucleases, Zinc finger nucleases (ZFNs), transcription-activator like effector nucleases (TALENs) and CRISPR/Cas system.

Over expression of a polypeptide by genome editing can be achieved by: (i) replacing an endogenous sequence encoding the polypeptide of interest or a regulatory sequence under the control which it is placed, and/or (ii) inserting a new gene encoding the polypeptide of interest in a targeted region of the genome, and/or (iii) introducing point mutations which result in up-regulation of the gene encoding the polypeptide of interest (e.g., by altering the regulatory sequences such as promoter, enhancers, 5'-UTR and/or 3'-UTR, or mutations in the coding sequence).

Homology Directed Repair (HDR)

Homology Directed Repair (HDR) can be used to generate specific nucleotide changes (also known as gene "edits") ranging from a single nucleotide change to large insertions. In order to utilize HDR for gene editing, a DNA "repair template" containing the desired sequence must be delivered into the cell type of interest with the guide RNA [gRNA(s)] and Cas9 or Cas9 nickase. The repair template must contain the desired edit as well as additional homologous sequence immediately upstream and downstream of the target (termed left and right homology arms). The length and binding position of each homology arm is dependent on the size of the change being introduced. The repair template can be a single stranded oligonucleotide, double-stranded oligonucleotide, or double-stranded DNA plasmid depending on the specific application. It is worth noting that the repair template must lack the Protospacer Adjacent Motif (PAM) sequence that is present in the genomic DNA, otherwise the repair template becomes a suitable target for Cas9 cleavage. For example, the PAM could be mutated such that it is no longer present, but the coding region of the gene is not affected (i.e. a silent mutation).

The efficiency of HDR is generally low (<10% of modified alleles) even in cells that express Cas9, gRNA and an exogenous repair template. For this reason, many laboratories are attempting to artificially enhance HDR by synchronizing the cells within the cell cycle stage when HDR is most active, or by chemically or genetically inhibiting genes involved in Non-Homologous End Joining (NHEJ). The low efficiency of HDR has several important practical implications. First, since the efficiency of Cas9 cleavage is relatively high and the efficiency of HDR is relatively low, a portion of the Cas9-induced double strand breaks (DSBs) will be repaired via NHEJ. In other words, the resulting population of cells will contain some combination of wild-type alleles, NHEJ-repaired alleles, and/or the desired HDR-edited allele. Therefore, it is important to confirm the presence of the desired edit experimentally, and if necessary, isolate clones containing the desired edit.

The HDR method was successfully used for targeting a specific modification in a coding sequence of a gene in plants (Budhagatapalli Nagaveni et al. 2015. "Targeted Modification of Gene Function Exploiting Homology-Directed Repair of TALEN-Mediated Double-Strand Breaks in Barley". G3 (Bethesda). 2015 September; 5(9): 1857-1863). Thus, the gfp-specific transcription activator-like effector nucleases were used along with a repair template that, via HDR, facilitates conversion of gfp into yfj, which is associated with a single amino acid exchange in the gene product. The resulting yellow-fluorescent protein accumulation along with sequencing confirmed the success of the genomic editing.

Similarly, Zhao Yongping et al. 2016 (An alternative strategy for targeted gene replacement in plants using a dual-sgRNA/Cas9 design. *Scientific Reports* 6, Article number. 23890 (2016)) describe co-transformation of *Arabidopsis* plants with a combinatory dual-sgRNA/Cas9 vector that successfully deleted miRNA gene regions (MIR169a and MIR827a) and second construct that contains sites homologous to *Arabidopsis* TERMINAL FLOWER 1 (TFL1) for homology-directed repair (HDR) with regions corresponding to the two sgRNAs on the modified construct to provide both targeted deletion and donor repair for targeted gene replacement by HDR.

Activation of Target Genes Using CRISPR/Cas9

Many bacteria and archea contain endogenous RNA-based adaptive immune systems that can degrade nucleic acids of invading phages and plasmids. These systems consist of clustered regularly interspaced short palindromic repeat (CRISPR) genes that produce RNA components and CRISPR associated (Cas) genes that encode protein components. The CRISPR RNAs (crRNAs) contain short stretches of homology to specific viruses and plasmids and act as guides to direct Cas nucleases to degrade the complementary nucleic acids of the corresponding pathogen. Studies of the type II CRISPR/Cas system of *Streptococcus pyogenes* have shown that three components form an RNA/protein complex and together are sufficient for sequence-specific nuclease activity: the Cas9 nuclease, a crRNA containing 20 base pairs of homology to the target sequence, and a trans-activating crRNA (tracrRNA) (Jinek et al. *Science* (2012) 337: 816-821.). It was further demonstrated that a synthetic chimeric guide RNA (gRNA) composed of a fusion between crRNA and tracrRNA could direct Cas9 to cleave DNA targets that are complementary to the crRNA in vitro. It was also demonstrated that transient expression of CRISPR-associated endonuclease (Cas9) in conjunction with synthetic gRNAs can be used to produce targeted double-stranded brakes in a variety of different species.

The CRISPR/Cas9 system is a remarkably flexible tool for genome manipulation. A unique feature of Cas9 is its ability to bind target DNA independently of its ability to cleave target DNA. Specifically, both RuvC- and HNH-nuclease domains can be rendered inactive by point mutations (D10A and H840A in SpCas9), resulting in a nuclease dead Cas9 (dCas9) molecule that cannot cleave target DNA. The dCas9 molecule retains the ability to bind to target DNA based on the gRNA targeting sequence. The dCas9 can be tagged with transcriptional activators, and targeting these dCas9 fusion proteins to the promoter region results in robust transcription activation of downstream target genes. The simplest dCas9-based activators consist of dCas9 fused directly to a single transcriptional activator. Importantly, unlike the genome modifications induced by Cas9 or Cas9 nickase, dCas9-mediated gene activation is reversible, since it does not permanently modify the genomic DNA.

Indeed, genome editing was successfully used to overexpress a protein of interest in a plant by, for example, mutating a regulatory sequence, such as a promoter to overexpress the endogenous polynucleotide operably linked to the regulatory sequence. For example, U.S. Patent Application Publication No. 20160102316 to Rubio Munoz, Vicente et al. which is fully incorporated herein by reference, describes plants with increased expression of an endogenous DDA1 plant nucleic acid sequence wherein the endogenous DDA1 promoter carries a mutation introduced by mutagenesis or genome editing which results in increased expression of the DDA1 gene, using for example, CRISPR. The method involves targeting of Cas9 to the specific genomic locus, in this case DDA1, via a 20 nucleotide guide sequence of the single-guide RNA. An online CRISPR Design Tool can identify suitable target sites (www(dot)tools(dot)genome-engineering(dot)org. Ran et al. Genome engineering using the CRISPR-Cas9 system nature protocols, VOL.8 NO.11, 2281-2308, 2013).

The CRISPR-Cas system was used for altering gene expression in plants as described in U.S. Patent Application publication No. 20150067922 to Yang; Yinong et al., which is fully incorporated herein by reference. Thus, the engineered, non-naturally occurring gene editing system comprises two regulatory elements, wherein the first regulatory element (a) operable in a plant cell operably linked to at least one nucleotide sequence encoding a CRISPR-Cas system guide RNA (gRNA) that hybridizes with the target sequence in the plant, and a second regulatory element (b) operable in a plant cell operably linked to a nucleotide sequence encoding a Type-II CRISPR-associated nuclease, wherein components (a) and (b) are located on same or different vectors of the system, whereby the guide RNA targets the target sequence and the CRISPR-associated nuclease cleaves the DNA molecule, thus altering the expression of a gene product in a plant. It should be noted that the CRISPR-associated nuclease and the guide RNA do not naturally occur together.

In addition, as described above, point mutations which activate a gene-of-interest and/or which result in overexpression of a polypeptide-of-interest can be also introduced into plants by means of genome editing. Such mutation can be for example, deletions of repressor sequences which result in activation of the gene-of-interest; and/or mutations which insert nucleotides and result in activation of regulatory sequences such as promoters and/or enhancers.

The CRIPSR/Cas system for genome editing contains two distinct components: a gRNA and an endonuclease Cas9. The gRNA is typically a 20 nucleotide sequence encoding a combination of the target homologous sequence (crRNA) and the endogenous bacterial RNA that links the crRNA to the Cas9 nuclease (tracrRNA) in a single chimeric transcript. The gRNA/Cas9 complex is recruited to the target sequence by the base-pairing between the gRNA sequence and the complement genomic DNA. For successful binding of Cas9, the genomic target sequence must also contain the correct Protospacer Adjacent Motif (PAM) sequence immediately following the target sequence. The binding of the gRNA/Cas9 complex localizes the Cas9 to the genomic target sequence so that the Cas9 can cut both strands of the DNA causing a double-strand break.

Modified versions of the Cas9 enzyme containing a single inactive catalytic domain, either RuvC- or HNH-, are called 'nickases'. With only one active nuclease domain, the Cas9 nickase cuts only one strand of the target DNA, creating a single-strand break or 'nick'. A single-strand break, or nick, is normally quickly repaired through the HDR pathway, using the intact complementary DNA strand as the template. However, two proximal, opposite strand nicks introduced by a Cas9 nickase are treated as a double-strand break, in what is often referred to as a 'double nick' CRISPR system. A double-nick can be repaired by either NHEJ or HDR depending on the desired effect on the gene target. Modified versions of the Cas9 enzyme containing two inactive catalytic domains (dead Cas9, or dCas9) have no nuclease activity while still able to bind to DNA based on gRNA specificity. The dCas9 can be utilized as a platform for DNA transcriptional regulators to activate or repress gene expression by fusing the inactive enzyme to known regulatory domains. For example, the binding of dCas9 alone to a target sequence in genomic DNA can interfere with gene transcription. There are a number of publically available tools available to help choose and/or design target sequences as well as lists of bioinformatically determined unique gRNAs for different genes in different species such as the Feng Zhang lab's Target Finder, the Michael Boutros lab's Target Finder (E-CRISP), the RGEN Tools: Cas-OFFinder, the CasFinder: Flexible algorithm for identifying specific Cas9 targets in genomes and the CRISPR Optimal Target Finder.

In order to use the CRISPR system, both gRNA and Cas9 should be expressed in a target cell. The insertion vector can contain both cassettes on a single plasmid or the cassettes are expressed from two separate plasmids. CRISPR plasmids are commercially available such as the px330 plasmid from Addgene.

"Hit and run" or "in-out"—involves a two-step recombination procedure. In the first step, an insertion-type vector containing a dual positive/negative selectable marker cassette is used to introduce the desired sequence alteration. The insertion vector contains a single continuous region of homology to the targeted locus and is modified to carry the mutation of interest. This targeting construct is linearized with a restriction enzyme at a one site within the region of homology, electroporated into the cells, and positive selection is performed to isolate homologous recombinants. These homologous recombinants contain a local duplication that is separated by intervening vector sequence, including the selection cassette. In the second step, targeted clones are subjected to negative selection to identify cells that have lost the selection cassette via intrachromosomal recombination between the duplicated sequences. The local recombination event removes the duplication and, depending on the site of recombination, the allele either retains the introduced mutation or reverts to wild type. The end result is the introduction of the desired modification without the retention of any exogenous sequences.

Meganucleases—Meganucleases are commonly grouped into four families: the LAGLIDADG family, the GIY-YIG family, the His-Cys box family and the HNH family. These families are characterized by structural motifs, which affect catalytic activity and recognition sequence. For instance, members of the LAGLIDADG family are characterized by having either one or two copies of the conserved LAGLIDADG motif. The four families of meganucleases are widely separated from one another with respect to conserved structural elements and, consequently, DNA recognition sequence specificity and catalytic activity. Meganucleases are found commonly in microbial species and have the unique property of having very long recognition sequences (>14 bp) thus making them naturally very specific for cutting at a desired location. This can be exploited to make site-specific double-stranded breaks in genome editing. One of skill in the art can use these naturally occurring meganucleases, however the number of such naturally occurring meganucleases is limited. To overcome this challenge, mutagenesis and high throughput screening methods have been used to create meganuclease variants that recognize unique sequences. For example, various meganucleases have been fused to create hybrid enzymes that recognize a new sequence. Alternatively, DNA interacting amino acids of the meganuclease can be altered to design sequence specific meganucleases (see e.g., U.S. Pat. No. 8,021,867). Meganucleases can be designed using the methods described in e.g., Certo, M T et al. Nature Methods (2012) 9:073-975; U.S. Pat. Nos. 8,304,222; 8,021,867; 8,119,381; 8,124,369; 8, 129,134; 8,133,697; 8,143,015; 8,143,016; 8, 148,098; or 8,163,514, the contents of each are incorporated herein by reference in their entirety. Alternatively, meganucleases with site specific cutting characteristics can be obtained using commercially available technologies e.g., Precision Biosciences' Directed Nuclease Editorm genome editing technology.

ZFNs and TALENs—Two distinct classes of engineered nucleases, zinc-finger nucleases (ZFNs) and transcription activator-like effector nucleases (TALENs), have both proven to be effective at producing targeted double-stranded breaks (Christian et al., 2010; Kim et al., 1996; Li et al., 2011; Mahfouz et al., 2011; Miller et al., 2010).

Basically, ZFNs and TALENs restriction endonuclease technology utilizes a non-specific DNA cutting enzyme which is linked to a specific DNA binding domain (either a series of zinc finger domains or TALE repeats, respectively). Typically a restriction enzyme whose DNA recognition site and cleaving site are separate from each other is selected. The cleaving portion is separated and then linked to a DNA binding domain, thereby yielding an endonuclease with very high specificity for a desired sequence. An exemplary restriction enzyme with such properties is FokI. Additionally FokI has the advantage of requiring dimerization to have nuclease activity and this means the specificity increases dramatically as each nuclease partner recognizes a unique DNA sequence. To enhance this effect, FokI nucleases have been engineered that can only function as heterodimers and have increased catalytic activity. The heterodimer functioning nucleases avoid the possibility of unwanted homodimer activity and thus increase specificity of the double-stranded break.

Thus, for example to target a specific site, ZFNs and TALENs are constructed as nuclease pairs, with each member of the pair designed to bind adjacent sequences at the targeted site. Upon transient expression in cells, the nucleases bind to their target sites and the FokI domains heterodimerize to create a double-stranded break. Repair of these double-stranded breaks through the nonhomologous end-joining (NHEJ) pathway most often results in small deletions or small sequence insertions. Since each repair made by NHEJ is unique, the use of a single nuclease pair can produce an allelic series with a range of different deletions at the target site. The deletions typically range anywhere from a few base pairs to a few hundred base pairs in length, but larger deletions have successfully been generated in cell culture by using two pairs of nucleases simultaneously (Carlson et al., 2012; Lee et al., 2010). In addition, when a fragment of DNA with homology to the targeted region is introduced in conjunction with the nuclease pair, the double-stranded break can be repaired via homology directed repair to generate specific modifications (Li et al., 2011; Miller et al., 2010; Umov et al., 2005).

Although the nuclease portions of both ZFNs and TALENs have similar properties, the difference between these engineered nucleases is in their DNA recognition peptide. ZFNs rely on Cys2-His2 zinc fingers and TALENs on TALEs. Both of these DNA recognizing peptide domains have the characteristic that they are naturally found in combinations in their proteins. Cys2-His2 Zinc fingers typically found in repeats that are 3 bp apart and are found in diverse combinations in a variety of nucleic acid interacting proteins. TALEs on the other hand are found in repeats with a one-to-one recognition ratio between the amino acids and the recognized nucleotide pairs. Because both zinc fingers and TALEs happen in repeated patterns, different combinations can be tried to create a wide variety of sequence specificities. Approaches for making site-specific zinc finger endonucleases include, modular assembly (where Zinc fingers correlated with a triplet sequence are attached in a row to cover the required sequence), OPEN (low-stringency selection of peptide domains vs. triplet nucleotides followed by high-stringency selections of peptide combination vs. the final target in bacterial systems), and bacterial one-hybrid screening of zinc finger libraries, among others. ZFNs can also be designed and obtained commercially from e.g., Sangamo Biosciences™ (Richmond, Calif.).

Method for designing and obtaining TALENs are described in e.g. Reyon et al. Nature Biotechnology 2012 May; 30(5):460-5; Miller et al. Nat Biotechnol. (2011) 29: 143-148; Cermak et al. Nucleic Acids Research (2011) 39 (12): e82 and Zhang et al. Nature Biotechnology (2011) 29 (2): 149-53. A recently developed web-based program named Mojo Hand was introduced by Mayo Clinic for designing TAL and TALEN constructs for genome editing applications (can be accessed through www(dot)talendesign (dot)org). TALEN can also be designed and obtained commercially from e.g., Sangamo Biosciences™ (Richmond, Calif.).

Site-Specific Recombinases—The Cre recombinase derived from the P1 bacteriophage and Flp recombinase derived from the yeast *Saccharomyces cerevisiae* are site-specific DNA recombinases each recognizing a unique 34 base pair DNA sequence (termed "Lox" and "FRT", respectively) and sequences that are flanked with either Lox sites or FRT sites can be readily removed via site-specific recombination upon expression of Cre or Flp recombinase, respectively. For example, the Lox sequence is composed of an asymmetric eight base pair spacer region flanked by 13 base pair inverted repeats. Cre recombines the 34 base pair lox DNA sequence by binding to the 13 base pair inverted repeats and catalyzing strand cleavage and religation within the spacer region. The staggered DNA cuts made by Cre in the spacer region are separated by 6 base pairs to give an overlap region that acts as a homology sensor to ensure that only recombination sites having the same overlap region recombine.

Basically, the site specific recombinase system offers means for the removal of selection cassettes after homologous recombination. This system also allows for the generation of conditional altered alleles that can be inactivated or activated in a temporal or tissue-specific manner. Of note, the Cre and Flp recombinases leave behind a Lox or FRT "scar" of 34 base pairs. The Lox or FRT sites that remain are typically left behind in an intron or 3' UTR of the modified locus, and current evidence suggests that these sites usually do not interfere significantly with gene function.

Thus, Cre/Lox and Flp/FRT recombination involves introduction of a targeting vector with 3' and 5' homology arms containing the mutation of interest, two Lox or FRT sequences and typically a selectable cassette placed between the two Lox or FRT sequences. Positive selection is applied and homologous recombinants that contain targeted mutation are identified. Transient expression of Cre or Flp in conjunction with negative selection results in the excision of the selection cassette and selects for cells where the cassette has been lost. The final targeted allele contains the Lox or FRT scar of exogenous sequences.

Transposases—As used herein, the term "transposase" refers to an enzyme that binds to the ends of a transposon and catalyzes the movement of the transposon to another part of the genome.

As used herein the term "transposon" refers to a mobile genetic element comprising a nucleotide sequence which can move around to different positions within the genome of a single cell. In the process the transposon can cause mutations and/or change the amount of a DNA in the genome of the cell.

A number of transposon systems that are able to also transpose in cells e.g. vertebrates have been isolated or designed, such as Sleeping Beauty [Izsvik and Ivics Molecular Therapy (2004) 9, 147-156], piggyBac [Wilson et al. Molecular Therapy (2007) 15, 139-145], Tol2 [Kawakami et al. PNAS (2000) 97 (21): 11403-11408] or Frog Prince [Miskey et al. Nucleic Acids Res. December 1, (2003) 31(23): 6873-6881]. Generally, DNA transposons translocate from one DNA site to another in a simple, cut-and-paste manner. Each of these elements has their own advantages, for example, Sleeping Beauty is particularly useful in region-specific mutagenesis, whereas Tol2 has the highest tendency to integrate into expressed genes. Hyperactive systems are available for Sleeping Beauty and piggyBac. Most importantly, these transposons have distinct target site preferences, and can therefore introduce sequence alterations in overlapping, but distinct sets of genes. Therefore, to achieve the best possible coverage of genes, the use of more than one element is particularly preferred. The basic mechanism is shared between the different transposases, therefore we will describe piggyBac (PB) as an example.

PB is a 2.5 kb insect transposon originally isolated from the cabbage looper moth, *Trichoplusia ni*. The PB transposon consists of asymmetric terminal repeat sequences that flank a transposase, PBase. PBase recognizes the terminal repeats and induces transposition via a "cut-and-paste" based mechanism, and preferentially transposes into the host genome at the tetranucleotide sequence TTAA. Upon insertion, the TTAA target site is duplicated such that the PB transposon is flanked by this tetranucleotide sequence. When mobilized, PB typically excises itself precisely to reestablish a single TTAA site, thereby restoring the host sequence to its pretransposon state. After excision, PB can transpose into a new location or be permanently lost from the genome.

Typically, the transposase system offers an alternative means for the removal of selection cassettes after homologous recombination quit similar to the use Cre/Lox or Flp/FRT. Thus, for example, the PB transposase system involves introduction of a targeting vector with 3' and 5' homology arms containing the mutation of interest, two PB terminal repeat sequences at the site of an endogenous TTAA sequence and a selection cassette placed between PB terminal repeat sequences. Positive selection is applied and homologous recombinants that contain targeted mutation are identified. Transient expression of PBase removes in conjunction with negative selection results in the excision of the selection cassette and selects for cells where the cassette has been lost. The final targeted allele contains the introduced mutation with no exogenous sequences.

For PB to be useful for the introduction of sequence alterations, there must be a native TTAA site in relatively close proximity to the location where a particular mutation is to be inserted.

Genome editing using recombinant adeno-associated virus (rAAV) platform—this genome-editing platform is based on rAAV vectors which enable insertion, deletion or substitution of DNA sequences in the genomes of live mammalian cells. The rAAV genome is a single-stranded deoxyribonucleic acid (ssDNA) molecule, either positive- or negative-sensed, which is about 4.7 kb long. These single-stranded DNA viral vectors have high transduction rates and have a unique property of stimulating endogenous homologous recombination in the absence of double-strand DNA breaks in the genome. One of skill in the art can design a rAAV vector to target a desired genomic locus and perform both gross and/or subtle endogenous gene alterations in a cell. rAAV genome editing has the advantage in that it targets a single allele and does not result in any off-target genomic alterations. rAAV genome editing technology is commercially available, for example, the rAAV GENESIS™ system from Horizon™ (Cambridge, UK).

Methods for qualifying efficacy and detecting sequence alteration are well known in the art and include, but not limited to, DNA sequencing, electrophoresis, an enzyme-based mismatch detection assay and a hybridization assay such as PCR, RT-PCR, RNase protection, in-situ hybridization, primer extension, Southern blot, Northern Blot and dot blot analysis.

Sequence alterations in a specific gene can also be determined at the protein level using e.g. chromatography, electrophoretic methods, immunodetection assays such as ELISA and western blot analysis and immunohistochemistry.

In addition, one ordinarily skilled in the art can readily design a knock-in/knock-out construct including positive and/or negative selection markers for efficiently selecting transformed cells that underwent a homologous recombination event with the construct. Positive selection provides a means to enrich the population of clones that have taken up foreign DNA. Non-limiting examples of such positive markers include glutamine synthetase, dihydrofolate reductase (DHFR), markers that confer antibiotic resistance, such as neomycin, hygromycin, puromycin, and blasticidin S resistance cassettes. Negative selection markers are necessary to select against random integrations and/or elimination of a marker sequence (positive marker). Non-limiting examples of such negative markers include the herpes simplex-thymidine kinase (HSV-TK) which converts ganciclovir (GCV) into a cytotoxic nucleoside analog, hypoxanthine phosphoribosyltransferase (HPRT) and adenine phosphoribosytransferase (ARPT).

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof. Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is understood that any Sequence Identification Number (SEQ ID NO) disclosed in the instant application can refer to either a DNA sequence or a RNA sequence, depending on the context where that SEQ ID NO is mentioned, even if that SEQ ID NO is expressed only in a DNA sequence format or a RNA sequence format. For example, SEQ ID NO: 55 is expressed in a DNA sequence format (e.g., reciting T for thymine), but it can refer to either a DNA sequence that corresponds to an MBI3 nucleic acid sequence, or the RNA sequence of an RNA molecule nucleic acid sequence. Similarly, though some sequences are expressed in a RNA sequence format (e.g., reciting U for uracil), depending on the actual type of molecule being described, it can refer to either the sequence of a RNA molecule comprising a dsRNA, or the sequence of a DNA molecule that corresponds to the RNA sequence shown. In any event, both DNA and RNA molecules having the sequences disclosed with any substitutes are envisioned.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non-limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak el al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Whole Organism Bacterial Assay on Target Insects

Growth of bacterial pure cultures in shake flask Bacterial isolates listed in Table 12 below were grown in V8 media (described hereinbelow) in 250 ml Erlenmeyer flasks for 3-7 days at temperatures ranging from 25° C. to 37° C. (depending on the organism). One liter of V8 medium was prepared as follows: 200 ml of ATCC medium 343 V8 juice agar, 3 grams of $CaCO_3$, 15 grams of Agar, and Tap water to 1.0 L. pH was adjusted to 7.2. The V8 medium was autoclaved at 121° C. for 15 minutes.

Bacterial Screening Assays

The bacterial isolates listed in Table 12 were screened for their potential insecticidal activity against various target insects. Cultures of bacterial isolates were prepared as described above, and were further referred to as the "treatment" hereinunder. The effect of each isolate as a treatment against insects was quantified by counting the number of dead insects following treatment. A positive result was defined as having 30% mortality or more. Mortality is calculated as [Number of dead insects] divided by [total insects]. For example, 3 dead insects out of 10 insects equals 30% mortality.

TABLE 12

Bacterial isolates having insecticidal activity

| Reference Number | Bacterial isolate complete name | Polyn. SEQ ID NO: of 16SrRNA | Deposit No |
|---|---|---|---|
| A190 | Bacillus amyloliquejaciens A190 | 764 | NRRL B-67464 |
| P243 | Bacillus subtilis P243 | 754 | NRRL B-67459 |
| M979 | Bacillus thuringiensis M979 | 753 | NRRL B-67457 |
| P63 | Massilia aurea P63 | 755 | NRRL B-67461 |
| G706 | Rhodococcus sp. G706 | 756 | — |
| E132 | Stenotrophomonas maltophilla E132 | 757 | NRRL B-67460 |
| A918 | Streptomyces aurantiacus A918 | 758 | — |
| O180 | Streptomyces badius O180 | 763 | — |
| B670 | Streptomyces mirabilis B670 | 759 | NRRL B-67463 |
| F427 | Streptomyces scopuliridis F427 | 761 | NRRL B-67458 |
| E128 | Streptomyces sp. E128 | 760 | NRRL B-67462 |
| L219 | Streptomyces sp. L219 | 762 | — |

Table 12.
"Polyn" = polynucleotide;
"Polyp." = polypeptide;

Screening Using Beet Armyworm Eggs—

Activity against Beet Armyworm (Spodoptera exigua) was screened on diet overlay bioassays. The appropriate artificial insect diet was dispensed into each well of a standard 96 well plate and allowed to dry. Once the diet solidified, 100 μL of the treatment was pipetted into the appropriate number of wells and allowed to dry. Washed Beet Armyworm eggs were suspended in a 0.1% agar solution at a ratio 1 mL eggs: 20 mL agar. 30 μL of egg-agar solution was pipetted into each well of a 96 well plate. Larval mortality was scored at 4 days after treatment.

Screening Lygus Using Floral Foam—

Activity against Lygus (Lygus hesperus) was screened on 12 well plate arenas. Foam from floral foam bricks (Oasis Floral Products [www(dot)smithersoasis(dot)com] were cut into rings. These were used to line the inside of 12 well plates. Treatments were prepared by mixing with a sucrose solution in which the final mixture contained 10% sucrose solution and 90% treatment. 400 μl of the treatment mixture was pipetted onto each floral foam ring. Approximately five $2^{nd}$ to $3^{rd}$ instar larvae were added to each well. Mortality was scored at 4 days after exposure to the treatment diet.

Screening Using 1st Instar Cabbage Loopers—

Activity against Cabbage Loopers (Trichoplusia ni) was screened on Diet Overlay Bioassays. The appropriate artificial insect diet was dispensed into each well of a standard 96 well plate and allowed to dry. Once the diet solidified, 100 μl of the treatment was pipetted into the appropriate number of wells and allowed to dry. A single $1^{st}$ instar larva was delivered into each well of a 96 well plate. Mortality was scored at 4 days after treatment.

The results of the screening assays are summarized in Table 13 below.

TABLE 13

Results of Bacterial isolates having insecticidal activity

| Bacterial isolate reference number | Bio-assay Type | % Mortality Rep 1 | % Mortality Rep 2 | % Mortality Rep 3 | AVG. Mortality |
|---|---|---|---|---|---|
| *Bacillus amyloliquefaciens* A190 | BAW | 100 | 67 | 67 | 78 |
| *Streptomyces aurantiacus* A918 | BAW | 80 | 67 | 67 | 71 |
| *Streptomyces mirabilis* B670 | CL | 50 | 59 | 56 | 55 |
| *Streptomyces* sp. E128 | Lygus | 100 | 60 | 88 | 83 |
| *Stenotrophomonas maltophilia* E132 | Lygus | 90 | 0 | 100 | 63 |
| *Streptomyces scopuliridis* F427 | Lygus | 100 | 66 | 77 | 81 |
| *Rhodococcus* sp. G706 | Lygus | 66 | 100 | 88 | 85 |
| *Streptomyces* sp. L219 | BAW | 100 | stunted | stunted | 100 |
| *Bacillus thuringiensis* M979 | BAW | Stunted | stunted | stunted | 0 |
| *Streptomyces badius* O180 | BAW | Stunted | stunted | stunted | 0 |
| *Massilia aurea* P63 | BAW | 58 | stunted | stunted | 58 |
| *Bacillus subtilis* P243 | CL | 50 | 53 | 54 | 52 |

Table 13.
"Rep" = biological repeat;
"AVG." = average.
"stunted"—moderate reduction in insect mass compared to negative controls.
"BAW" = Beet Armyworm (*Spodoptera exigua*);
"CL" = Cabbage Loopers (*Trichoplusia ni*);
"Lygus" = *Lygus Hesperus*.
A positive result was defined as having 30% mortality or more.

Example 2

Enzymatic Activity of Bacterial Isolates Having Insecticidal Activity

Enzymatic activity was assessed with the BioMerieux API ZYM strip test according to the manufacturer's instructions (bioMerieux, Inc., HAZELWOOD, Mo.). In brief, isolates were plated on V8 media and incubated at 27° C. for 3 days. Colonies were transferred to 20 ml of liquid V8 media and incubated at 27° C. for 1-5 days, as described in Table 14 below. Cells were separated from media by centrifugation at 10,000 g for 5 minutes and supernatant was discarded. Cells were resuspended in sterile deionized water and adjusted to a concentration of 5-6 McFarland. Alternatively, E128 was transferred from a V8 plate and adjusted to 5-6 McFarland in sterile deionized water. Strip boxes were prepared by adding 5 ml of sterile media to the bottom of the tray prior to putting the strip in the box. 65 μl of cell suspension was added to each well and strips were incubated in the provided tray for 4 hours at 37° C. After incubation, 1 drop of ZYM A reagent was added to each well, followed by 1 drop ZYM B reagent and color was allowed to develop within a minimum of 5 minutes and no more than 24 hours. The test was assessed as directed in Table 15 below.

TABLE 14

Incubation time of isolates for enzymatic activity assay

| ISOLATE ID | E128 | P063 | F427 | A190 | P243 | B670 | M979 | E132 |
|---|---|---|---|---|---|---|---|---|
| INCUBATION TIME (DAYS) | 3 | 5 | 5 | 1 | 1 | 1 | 1 | 1 |
| LIQUID/SOLID CULTURE | Solid | Liquid | Liquid | Liquid | Liquid | Liquid | Liquid | Liquid |

Table 14. Provided are the incubation periods for each of the bacterial isolates in the V8 medium (liquid or solid) prior to their use in the BioMerieux API ZYM strip test.

TABLE 15

Enzymes assayed by BioMerieux API ZYM strip test and color of positive reaction.

| No. | Enzyme assayed for | Substrate | pH | Positive | Negative |
|---|---|---|---|---|---|
| 1 | Control | | 8.5 | Colorless or color of the sample if it has intense coloration | |
| 2 | Alkaline phosphatase | 2-naphthyl phosphate | 6.5 | Violet | Colorless or very pale yellow |
| 3 | Esterase (C 4) | 2-naphythyl butyrate | 7.5 | Violet | pale |
| 4 | Esterase Lipase (C 8) | 2-naphthyl caprylate | 7.5 | Violet | yellow |
| 5 | Lipase (C 14) | 2-naphthyl myrisate | 7.5 | Violet | |
| 6 | Leucine arylamidase | L-leucyl-2-naphthylamide | 7.5 | Orange | Colorless or very pale yellow |
| 7 | Valine arylamidase | L-valyl-2-naphthylamide | 7.5 | Orange | |
| 8 | Cysteine arylamidase | L-cystyl-2-naphthylamide | 7.5 | Orange | |
| 9 | Trypsin | N-benzoyl-DL-arginine-2-naphthylamide | 8.5 | Orange | |
| 10 | α-chymotrypsin | N-glutaryl-phenylalanine-2-naphthylamide | 7.5 | Orange | |
| 11 | Acid phsphatase | 2-naphthyl phosphate | 5.4 | Violet | Colorless or very pale yellow |

TABLE 15-continued

Enzymes assayed by BioMerieux API ZYM strip test and color of positive reaction.

| Enzyme | | | Interpretation | |
|---|---|---|---|---|
| No. | assayed for | Substrate | pH | Positive | Negative |
| 12 | Naphthol-AS-BI-phosphohydrolase | Naphthol-AS-BI-phosphate | 5.4 | Blue | Colorless or very pale yellow |
| 13 | α-galactosidase | 6-Br-2-naphthyl-αD-galactopyranoside | 5.4 | Violet | |
| 14 | β-galactosidase | 2-naphthyl-βD-galactopyranoside | 5.4 | Violet | |
| 15 | β-glucuronidase | Naphthol-AS-BI-βD-glucuronide | 5.4 | Blue | |
| 16 | α-glucosidase | 2-naphthyl-αD-glucopyranoside | 5.4 | Violet | |
| 17 | β-glucosidase | 6-Br-2-naphthyl-βD-glucopyranoside | 5.4 | Violet | |
| 18 | N-acetyl-β-glucosaminidase | 1-naphthyl-N-acetyl-βD-glucosaminide | 5.4 | Brown | |
| 19 | α-mannosidase | 6-Br-2-naphthyl-αD-mannopyranoside | 5.4 | Violet | |
| 20 | α-fucosidase | 2-naphthyl-αL-fucopyranoside | 5.4 | Violet | |

Table 15. Provided are the assay conditions for testing each of the listed enzymes in the bacterial isolates, and the expected response in case of positive or negative results.

TABLE 16

API-ZYM strip test results of enzymatic activity of isolates

| No | Enzyme assayed for | E128 | P63 | F427 | A190 | P243 | B670 | M979 | E132 |
|---|---|---|---|---|---|---|---|---|---|
| 1 | control | 0 | 0 | 0 | 0 | 0 | 0 | 0 | 0 |
| 2 | alkaline phosphatase | 5 | 5 | 5 | 5 | 5 | 0 | 5 | 5 |
| 3 | esterase (c 4) | 3 | 1 | 0 | 2 | 2 | 3 | 0 | 0 |
| 4 | esterase lipase (c 8) | 1 | 2 | 3 | 3 | 2 | 1 | 0 | 2 |
| 5 | lipase (c 14) | 0 | 1 | 2 | 0 | 0 | 0 | 0 | 1 |
| 6 | leucine arylamidase | 5 | 5 | 5 | 0 | 5 | 5 | 5 | 5 |
| 7 | valine arylamidase | 3 | 5 | 3 | 0 | 0 | 0 | 4 | 5 |
| 8 | cysteine arylamidase | 3 | 1 | 0 | 0 | 0 | 0 | 0 | 0 |
| 9 | trypsin | 0 | 1 | 0 | 0 | 0 | 0 | 0 | 5 |
| 10 | α-chymotrypsin | 0 | 5 | 0 | 0 | 0 | 0 | 5 | 0 |
| 11 | acid phsphatase | 5 | 5 | 4 | 3 | 5 | 3 | 5 | 5 |
| 12 | naphthol-as-bi-phosphohydrolase | 5 | 5 | 5 | 4 | 5 | 5 | 5 | 5 |
| 13 | α-galactosidase | 0 | 0 | 0 | 0 | 0 | 0 | 0 | 0 |
| 14 | β-galactosidase | 1 | 5 | 3 | 0 | 2 | 0 | 0 | 0 |
| 15 | β-glucuronidase | 0 | 0 | 0 | 0 | 0 | 0 | 0 | 0 |
| 16 | α-glucosidase | 1 | 5 | 5 | 0 | 3 | 0 | 5 | 5 |
| 17 | β-glucosidase | 0 | 5 | 5 | 0 | 5 | 0 | 3 | 5 |
| 18 | n-acetyl-β-glucosaminidase | 0 | 5 | 3 | 0 | 0 | 0 | 0 | 2 |
| 19 | α-mannosidase | 0 | 2 | 3 | 0 | 0 | 0 | 0 | 0 |
| 20 | α-fucosidase | 0 | 0 | 0 | 0 | 0 | 0 | 0 | 0 |

Table 16. API-ZYM colorimetric strip tests were used to qualitatively evaluate 20 enzymatic activities for each of the eight characterized isolates and to grade them on 0-5 scale, based on the color intensity produced. 0—no activity; 1—faint activity; 2—mild activity; 3—moderate activity; 4—strong activity; 5—very strong activity.

Example 3

Determination of Insect Spectrum Activity of Isolate E128

Fermentation of E128

Isolate E128, *Streptomyces* spp., was fermented for 50-70 hours at 27° C. in ISP1 media (Tryptone 5.0 g/L, Yeast extract 3.0 g/L), as described by the International *Streptomyces* Project. Once the fermentation run was complete, whole cell broth was heat-killed at 60° C. for 1 hour. Heat-killed whole cell broth was aliquoted and stored at −80° C. for future use.

E128 Broth Insect Spectrum $LC_{50}$ Determination

E128 broth $LC_{50}$ values for Cabbage Looper (*Trichoplusia ni*), Diamondback Moth (*Plutella xylostella*), Fall Armyworm (*Spodoptera frugiperda*) and Western Corn Rootworm (*Diabrotica virgifera virgifera*) were determined using diet overlay bioassays. The artificial insect diet was dispensed into each well of a standard 96 well plate and allowed to dry. Once the diet solidified, 100 μl of 100% to 3.125% serially diluted treatments were pipetted into the wells and allowed to dry. A single $1^{st}$ instar larva was delivered into each well of a 96 well plate. Mortality was scored at 4 days after treatment. Data was analyzed using Probit analysis (Table 17).

E128 broth $LC_{50}$ values for Southern Green Stinkbug (*Nezara viridula*) were determined using diet incorporation bioassays. The artificial insect diet was mixed with ⅒th volume of 100% to 6.25% serially diluted treatment and 200 μL of the mixture was dispensed onto a Parafilm that was already wrapped around single 1 oz. cups. Before this step, each 1 oz. cup was infested with 5 $2^{nd}$ instar insects. A second Parafilm layer was overlaid onto the diet and treatment mixture and wrapped around the cup. Mortality was scored at 4 days after treatment. Data was analyzed using Probit analysis (Table 17).

TABLE 17

E128 Broth $LC_{50}$ Values

| Target Pest | $LC_{50}$ |
|---|---|
| *Trichoplusia ni* | 3.5% v/v |
| *Plutella xylostella* | 1.03% v/v |
| *Spodoptera frugiperda* | 0.4% v/v |
| *Diabrotica virgifera virgifera* | 3% v/v |
| *Nezara viridula* | 3.3% v/v |

Table 17: Provided are the $LC_{50}$ values for the E128 bacterial isolate on each of the following target insects: *Trichoplusia ni*, *Plutella xylostella*, *Spodoptera frugiperda*, *Diabrotica virgifera virgifera* and *Nezara viridula*.

Reduction of On-Plant Leaf Damage Caused by *Spodoptera frugiperda*

Corn plants were grown until $2^{nd}$ leaf (V2) stage and the whole seedlings were dipped into 100% to 12.5% serially-diluted treatments E128 cell broth treatments, supplemented with 1/50 v/v spreader-sticker (Turbo™ by Bonide products, Inc.). After the seedlings were dried out for 1 hour they were wrapped with Micro-perforated Gusseted transparent French Bread Bags and infested with 20 $1^{st}$ instar *S. frugiperda* larvae. Then, the bags were sealed with stapler pins. Four days after bagging, the leaves of each plant from each treatment were detached, imaged and analyzed for damage areas (hollow regions) by counting pixels using the program ImageJ (Table 18). The leaf damage of each treatment was compared and the data was analyzed for statistical significance. $LC_{50}$ values were also determined (Table 19).

TABLE 18

E128 Cell Broth Protective Effect Against Corn Leaf Damaging by *Spodoptera frugiperda* (Provided by Damaged Leaf Area Pixel Counts)

| Target Pest | E128 Cell Broth Dilution | Mean Pixel Count | P-value |
| --- | --- | --- | --- |
| S. frugiperda | 100% v/v | 2362 | 0.102 |
| | 50% v/v | 4353.8 | 0.526 |
| | 25% v/v | 2955.5 | 0.178 |
| | 12.5% v/v | 10674.3 | 0.219 |
| | Mock (0% v/v) | 6929.7 | — |

Table 18. Provided are pixel counts for damaged areas of corn leaves treated with several E128 cell broth doses or a mock (1/50 spreader sticker) and infested with 20 $1^{st}$ instar *Spodoptera frugiperda* larvae.
The P-values reflect the difference between the given treatment and the mock.

TABLE 19

On-Plant $IC_{50}$ Results

| Target Pest | E128 Cell Broth $IC_{50}$ |
| --- | --- |
| S. frugiperda | 19.6% v/v |

Table 19: Provided is the on-plant E128 Cell Broth $IC_{50}$ value (Inhibitory Concentration 50)—E128 cell broth dilution that reduces corn leaf damage by *Spodoptera frugiperda* larvae by 50%—as calculated based on the leaf damage data in Table 17.

Reduction of *Tetranychus urticae* Eggs

Lima bean (*Phaseolus lunatus* cv. Henderson Baby) leaves were excised from the plants with the petiole intact. Using a circular cutter, 3 cm in diameter, the leaf tissue around the petiole was cut leaving part of leafs midrib and veins in place. Leaves were placed in modified plastic cups with the petiole in contact with $diH_2O$. 10 Twospotted spider mite (*Tetranychus urticae*) females were placed on the top of each disc and leaf discs were sprayed with the treatment: assay 1 was treated with 25% v/v and assay 2 treated with 40% v/v E128 whole cell broth. On day seven the number of living nymphs was counted on each leaf disc and compared to the control and the results are summarized in Table 20 below.

TABLE 20

E128 broth egg-reduction activity reflected by the numbers of newly hatched *Tetranychus* nymphs

| Assay NO. | E128 (Nymph number) | Positive control (Nymph number) | Water control (Nymph number) |
| --- | --- | --- | --- |
| 1 | 184.0 | 354.3 | 480.5 |
| 2 | 44.8 | 60.8 | 165.3 |

Table 20: Provided are the number of newly hatched nymphs of *Tetranychus urticae* following treatment with E128 cell broth at 25% v/v in assay 1 and 40% v/v in assay 2, a positive control (internal standard).

Activity Against *Lygus hesperus*

Activity against *Lygus* was screened on 12-well plate arenas. Foam from floral foam bricks (Oasis Floral Products www(dot)smithersoasis(dot)com) were cut into rings. These were used to line the inside of 12-well plates. Test substances were prepared with a 10% sucrose solution. 400 μl of the test substance (at the indicated concentrations as in Table 21) was pipetted onto each floral foam ring. Approximately five $2^{nd}$ to $3^{rd}$ instar larvae were added to each well. Mortality was scored at 4 days after exposure to the treated diet and the results are summarized in Table 21 below.

TABLE 21

E128 Broth Dose-Dependent *Lygus hesperus* Mortality

| Concentration | Average Mortality | Stdev |
| --- | --- | --- |
| E128 6% v/v | 20.68% | 5.67% |
| E128 12% v/v | 98.25% | 3.04% |
| E128 15% v/v | 94.12% | 10.19% |
| E128 30% v/v | 100.0% | 0.0% |

Table 21: Provided are the average mortality rates and standard deviation (STE) of *Lygus Hesperus* in the presence of increasing concentrations of E128 cell broth. Note that 100% mortality is achieved in the presence of 30% (v/v).

Example 4

Identifying Insecticidal Genes Suitable for Insect Pest Control

The present inventors have used database available sequence information for the identified bacteria described hereinabove (having the insecticidal activity), as well as of sequences belonging to several gene families thereof (as if further described below) to identify polynucleotide and polypeptide sequences having insecticidal activity. The sequences were assembled using a proprietary pipeline, predicted using Prokaryotic Dynamic Programming Genefinding Algorithm [Prodigal—BMC Bioinformatics. 2010 Mar. 8; 11(1):119], and further annotated using BLAST™ search [blast (dot) ncbi (dot) nlm (dot) nih (dot) gov/Blast (dot) cgi] against NCBI nr (non-redundant protein sequence database) and by further analyses such as for InterPro [ebi (dot) ac (dot) uk/interpro/] composition.

The present inventors have identified 50 polynucleotides and polypeptides of bacterial origin that encode for insecticidal proteins orally active against lepidopteran, coleopteran, hemipteran and/or Acari insect pests.

Genomic and Transcriptomic Profiling of Bacterial Isolates for Gene Discovery a. Genomic Profiling Total DNA was extracted from 12 target bacterial isolates described in Table 12. Total DNA was sent to a service lab (Omega Bioservices, GA USA) for QC (quality control) testing and sequencing. The obtained sequences were subjected to genome assembly and gene annotation Genome assembly—genomes of all isolates were assembled using a proprietary pipeline.

Gene prediction—gene prediction was performed using Prokaryotic Dynamic Programming Genefinding Algorithm [Prodigal—BMC Bioinformatics. 2010 Mar. 8; 11(1):119].

Gene annotation—Predicted genes and proteins were annotated using BLAST™ search [blast (dot) ncbi (dot) nlm (dot) nih (dot) gov/Blast (dot) cgi] against NCBI nr (non-redundant protein sequence database) and by further analysis by InterPro [ebi (dot) ac (dot) uk/interpro/].

b. Transcriptome Profiling

Growth curves on the identified bacterial isolates were performed in which samples were taken and evaluated for insecticidal activity. It is pointed out that the time points were relative to the growth rate of the specific organism. Samples collected at these time points were further taken and used for transcriptomics analysis. Total RNA was extracted and submitted to Omega Bioservices contract lab for RNA sequencing. Transcriptomics data were evaluated identification of highly expressed potential insecticidal genes.

Differential expression data analysis—RNA-seq uses next-generation sequencing (NGS) methods to sequence cDNA that has been derived from an RNA sample, and hence produces millions of short reads. These reads were then mapped onto a reference genome and the number of reads mapping within a genomic feature of interest (such as a gene) was used as a measure of the abundance of the feature in the analyzed sample, resulting with gene expression profile.

According to the gene expression profile, a correlation analysis was performed to identify genes, which are co-regulated under different developmental stages that are further associated with insecticidal phenotypes.

Identification of Insecticidal Genes from Proprietary Bacterial Isolates

The genes listed in Table 22 below were identified as insecticidal and, as shown later for can also confer insect-resistance traits in planta. The present inventors identified in each of the genes the presence or absence of a native signal peptide preceding the sequence of the mature protein. In cases of presence of such a native signal peptide, an amino acid sequence was derived, which was identical to the curated sequence albeit excluding the native signal peptide. For example, SEQ ID NO: 249 includes a native signal peptide (amino acids 1-29 of SEQ ID NO: 249) and a mature amino acid sequence (amino acids 30-249 of SEQ ID NO:249), and the "derived polypeptide" sequence (SEQ ID NO: 684) includes only amino acids 30-249 of SEQ ID NO: 249, i.e., the mature protein.

The identified genes, their curated polynucleotide and polypeptide sequences, as well as their derived polypeptides excluding the native signal peptide when such was identified, are summarized in Table 22 hereinbelow.

TABLE 22

Identified insecticidal genes

| Gene Name | Gene description | Bacterial isolate complete name | Polyn. SEQ ID NO: | Polyp. SEQ ID NO: | Derived polypeptide SEQ ID NO: |
|---|---|---|---|---|---|
| MBI3 | Uncharacterized protein YycO | *Bacillus amyloliquefaciens* A190 | 1 | 249 | 684 |
| MBI4 | uncharacterized protein YycP | *Bacillus amyloliquefiwiens* A190 | 2 | 250 | 680 |
| MBI7 | Fascin domain protein | *Bacillus thuringiensis* M979 | 3 | 251 | 667 |
| MBI11 | Microbial collagenase | *Bacillus thuringiensis* M979 | 4 | 252 | 665 |
| MBI13 | pXO1-55 | *Bacillus thuringiensis* M979 | 5 | 253 | 664 |
| MBI14 | Uncharacterized protein | *Bacillus thuringiensis* M979 | 6 | 254 | 683 |
| MBI17 | Cytoplasmic protein | *Massilia aurea* P63 | 7 | 255 | NA |
| MBI18 | Phospholipase | *Massilia aurea* P63 | 8 | 256 | NA |
| MBI22 | Outer membrane autotransporter | *Stenotrophomonas maitophilia* E132 | 9 | 257 | 661 |
| MBI23 | Membrane protein | *Streptomyces aurantiacus* A918 | 10 | 258 | 669 |
| MBI27 | Putative fibronectin type III domain protein | *Streptomyces mirabilis* B670 | 11 | 259 | 685 |
| MBI30 | Hypothetical protein | *Streptomyces mirabilis* B670 | 12 | 260 | 668 |
| MBI33 | Ig family protein | *Streptomyces* sp. E128 | 13 | 261 | 674 |
| MBI34 | Ricin B lectin | *Streptomyces* sp. E128 | 14 | 262 | 673 |

TABLE 22-continued Identified insecticidal genes

| Gene Name | Gene description | Bacterial isolate complete name | Polyn. SEQ ID NO: | Polyp. SEQ ID NO: | Derived polypeptide SEQ ID NO: |
|---|---|---|---|---|---|
| MBI35 | Hypothetical protein | *Streptomyces* sp. E128 | 15 | 263 | 682 |
| MBI36 | Secreted protein | *Streptomyces scopuliridis* F427 | 16 | 264 | 675 |
| MBI39 | Hypothetical protein | *Streptomyces scopuliridis* F427 | 7 | 265 | 658 |
| MBI42 | Hypothetical protein | *Streptomyces scopuliridis* F427 | 18 | 266 | NA |
| MBI43 | Hypothetical protein | *Streptomyces scopuliridis* F427 | 19 | 267 | 660 |
| MBI44 | Hypothetical protein | *Streptomyces scopuliridis* F427 | 20 | 268 | 659 |
| MBI46 | Hypothetical protein | *Streptomyces scopuliridis* F427 | 21 | 269 | NA |
| MBI48 | Hypothetical protein | *Streptomyces* sp. L219 | 22 | 270 | 671 |
| MBI50 | YD repeat protein | *Streptomyces* sp. L219 | 23 | 271 | 678 |
| MBI51 | Ricin-type beta-trefoil lectin domain protein | *Streptomyces* sp. L219 | 24 | 272 | 676 |
| MBI55 | Neutral ceramidase | *Streptomyces badius* O180 | 25 | 273 | 662 |
| MBI61 | Putative phage-related protein yobo | *Bacillus subtilis* P243 | 26 | 274 | NA |
| MBI63 | Hypothetical protein | *Streptomyces* sp. E128 | 27 | 275 | 656 |
| MBI68 | Type IV secretion protein Rhs | *Stenotrophomonas maltophilia* E132 | 28 | 276 | 681 |
| MBI71 | YD repeat protein | *Streptomyces* sp. E128 | 29 | 277 | 679 |
| MBI72 | Ricin B lectin | *Streptomyces* sp. E128 | 30 | 278 | 663 |
| MBI73 | Putative quercetin 2,3-dioxygenase pa1205 | *Streptomyces* sp. E128 | 31 | 279 | NA |
| MBI75 | YD repeat protein | *Streptomyces* sp. E128 | 32 | 280 | 657 |
| MBI76 | Hypothetical protein | *Streptomyces scopuliridis* F427 | 33 | 281 | NA |
| MBI79 | Chitin-binding protein | *Bacillus amyloliquefaciens* A190 | 34 | 282 | 666 |
| MBI82 | Hypothetical protein | *Streptomyces* sp. E128 | 35 | 283 | 677 |
| MBI22_H2 | Membrane protein | *Stenotrophomonas maltophilia* | 36 | 284 | 693 |
| MBI22_H3 | Membrane protein | *Stenotrophomonas* sp. | 37 | 285 | 695 |
| MBI27_H1 | Putative fibronectin type III domain protein | *Streptomyces olivochromogenes* | 38 | 286 | 689 |
| MBI27_H2 | Putative fibronectin type III domain protein | *Actinobacteria bacterium* | 39 | 287 | 696 |
| MBI27_H3 | Putative fibronectin type III domain protein | *Streptomyces* sp. | 40 | 288 | 686 |
| MBI27_H4 | Putative fibronectin type III domain protein | *Streptomyces* sp. | 41 | 289 | 694 |
| MBI27_H5 | Putative fibronectin type III domain protein | *Streptomyces* sp. | 42 | 290 | 697 |
| MBI27_H6 | Hypothetical protein | *Streptomyces* sp. | 43 | 291 | 691 |

TABLE 22-continued

Identified insecticidal genes

| Gene Name | Gene description | Bacterial isolate complete name | Polyn. SEQ ID NO: | Polyp. SEQ ID NO: | Derived polypeptide SEQ ID NO: |
|---|---|---|---|---|---|
| MBI27_H7 | Hypothetical protein | *Streptomyces* sp. | 44 | 292 | 692 |
| MBI27_H8 | Fibronectin type III | *Streptomyces* sp. | 45 | 293 | 688 |
| MBI27_H10 | 1,4-beta-cellobiosidase family protein | *Streptomyces* sp. | 46 | 294 | 690 |
| MBI27_H11 | Exoglucanase | *Streptomyces* sp. | 47 | 295 | 687 |
| MBI4_H4 | Ucharacterized protein YycP | *Bacillus siamensis firmicutes* | 48 | 296 | NA |
| POCM19 | Lysozyme m1 | *Rhodococcus* sp. G706 | 49 | 297 | 672 |
| POCM25 | Glycosyl hydrolase | *Streptomyces scopuliridis* F427 | 50 | 298 | 670 |

Table 22: Provided are the identified genes, their descriptions, bacterial isolate origin, polynucleotide and polypeptide sequence identifiers.
"polyn." = polynucleotide;
"polyp." = polypeptide;
"derived polypeptide" = amino acid of the mature polypeptide without the native signal peptide of the curated polypeptide
"NA"—not applicable.
When the curated polypeptide does not include a native signal peptide, there is no need to remove a signal peptide and to generate a SEQ ID NO: for a "derived" polypeptide.

Identification of Three Protein Families of Insecticides—

Thirty-seven of the 50 polynucleotides and polypeptides having insecticidal activity (described in Table 22 above), originating from the 12 proprietary bacterial isolate genomes, were incorporated into a unified database, also containing gene expression data produced ad hoc, as well as gene phylogeny, protein annotation, enzymatic function and pathway. The remaining 13 are orthologues of 3 of the aforementioned genes—MBI4 (SEQ ID NO: 250), MBI22 (SEQ ID NO: 257) and MBI27 (SEQ ID NO: 259)—which were identified by global identity search and further retained similar protein structure, as indicated by conservation of their domain composition (FIGS. 1A-C and Tables 22-26). These homologous genes were found to be insecticidal (as shown by the validation experiments which are described in Example 14 hereinbelow). All the above reflect the discovery of 3 protein families with characteristic insecticidal activity, rather than a group of unrelated polynucleotides with incidental insecticidal attributes.

MBI4, MBI22 and MBI27 families are depicted in FIGS. 1A, 1B and 1C, respectively, in evolutionary trees composed of the parental genes, their active orthologues and genes included in the 80% global identity space of each. The trees demonstrate the evolutionary relationship between the different SEQ ID NOs, the conservation of domain composition by all tree members and the retaining of insecticidal activity across the tree. Tables 22-26 also present the level of identity and similarity shared between the tree members. Based on this, sequences which are not explicitly included in the sequence listing of this application, yet holding sufficient global sequence homology to sequences of some embodiments of the invention, as well as at least one of the domain compositions (as summarized for the MBI4, MBI22 and MBI27 genes in Tables 28 and 29), are expected to become embedded in one of those trees instead of forming outgroups, and to exhibit insecticidal activity, thus being members of one of the three protein families.

As shown in Table 23 and in Tables 29-30 (domains) below, all members of the gene family of MBI4 comprise the same domain of IPR027295 and share at least 81.4% global identity and at least 92.5% global amino acid similarity, thus having a common structure. In addition, as validated for exemplary protein sequences of the MBI4 gene family, proteins having such common structure also exhibit a common function as a strong insecticide against various insects (Example 14, Tables 33 and 34).

As shown in Tables 24-25 and in Tables 29-30 (domains) below, all members of the gene family of MBI22 comprise at least one of the domains of IPR005546 and IPR006315 (all of the identified family members comprise both of these domains) and share at least 70% global identity and at least 80.3% global amino acid similarity, thus having a common structure. In addition, as validated for exemplary protein sequences of the MBI22 gene family, proteins having such common structure also exhibit a common function as a strong insecticide against various insects (Example 14, Tables 33 and 34).

As shown in Tables 26-27 and in Tables 29-30 (domains) below, all members of the gene family of MBI27 comprise at least one of the domains of IPR011658, IPR003961 and IPR0137833 (all of the identified family members comprise all three domains) and share at least 29% global identity and at least 49.2% global amino acid similarity, thus having a common structure). In addition, as validated for exemplary protein sequences of the MBI27 gene family, proteins having such common structure also exhibit a common function as a strong insecticide against various insects (Example 14, Tables 32 and 33).

TABLE 23

MBI4 Family Global Identity; Global Similarity

| SEQ ID NO | 250 | 296 | 306 | 307 | 308 | 309 | 310 | 311 | 312 | 313 | 314 | 315 | 486 | 487 | 488 | 489 | 490 |
|---|---|---|---|---|---|---|---|---|---|---|---|---|---|---|---|---|---|
| 250 | 100; 100 | 89.7; 96.1 | 98.7; 99.5 | 97.2; 99 | 96.1; 98.7 | 95.1; 99 | 94.2; 96.5 | 93.7; 97.2 | 92; 98.2 | 90.7; 96.9 | 86.6; 96.6 | 85.5; 95.9 | 92.8; 99.2 | 92.3; 98.5 | 96.1; 98.2 | 94.9; 97 | 92.7; 95.5 |
| 296 | 89.7; 96.1 | 100; 100 | 89.4; 95.6 | 89.4; 95.1 | 89.2; 95.6 | 91.5; 96.1 | 86.6; 93.9 | 89.6; 94.4 | 87.9; 95.9 | 95.8; 98.7 | 82.2; 94.1 | 81.4; 93 | 94.1; 96.9 | 92.3; 95.6 | 88.4; 95.1 | 87.3; 93.4 | 86.2; 92.5 |
| 306 | 98.7; 99.5 | 89.4; 95.6 | 100; 100 | 96.6; 98.5 | 96.4; 98.7 | 95.4; 99 | 93.9; 96.5 | 93.4; 97.2 | 91.7; 97.7 | 90.4; 96.4 | 86.3; 96.1 | 85.3; 95.4 | 92.5; 98.7 | 92; 97.9 | 96.1; 98.2 | 94.9; 97 | 92.7; 95.5 |
| 307 | 97.2; 99 | 89.4; 95.1 | 96.6; 98.5 | 100; 100 | 97.4; 98.7 | 95.4; 98.5 | 94.7; 96.5 | 93.4; 96.7 | 92.3; 97.7 | 90.4; 95.9 | 87.1; 95.9 | 85.5; 95.1 | 92.5; 98.2 | 93; 97.9 | 96.4; 98.2 | 95.7; 97 | 93.5; 95.5 |
| 308 | 96.1; 98.7 | 89.2; 95.6 | 96.4; 98.7 | 97.4; 98.7 | 100; 100 | 96.1; 99.5 | 95.7; 97.7 | 93.9; 97.7 | 92.8; 98.5 | 89.9; 95.9 | 86.6; 96.6 | 85.5; 95.9 | 92.5; 98.7 | 92.3; 97.9 | 96.4; 98.5 | 94.9; 97.2 | 93.2; 95.5 |
| 309 | 95.1; 99 | 91.5; 96.1 | 95.4; 99 | 95.4; 98.5 | 96.1; 99.5 | 100; 100 | 92.6; 97.5 | 97.7; 98.2 | 91.2; 98.2 | 92.8; 96.4 | 85.8; 96.9 | 84.8; 96.1 | 95.4; 99.2 | 94.1; 98.5 | 94.6; 99 | 93.4; 97.5 | 92.7; 96.2 |
| 310 | 94.2; 96.5 | 86.6; 93.9 | 93.9; 96.5 | 94.7; 96.5 | 95.7; 97.7 | 92.6; 97.5 | 100; 100 | 94.7; 99.2 | 90.4; 96.2 | 87.3; 94.2 | 84.3; 94.9 | 83.3; 94.2 | 89.3; 96.7 | 89.6; 95.9 | 93.9; 96.5 | 96.5; 98.5 | 94.2; 97 |
| 311 | 93.7; 97.2 | 89.6; 94.4 | 93.4; 97.2 | 93.4; 96.7 | 93.9; 97.7 | 97.7; 98.2 | 94.7; 99.2 | 100; 100 | 89.6; 96.5 | 91.1; 94.7 | 84.3; 95.2 | 83.3; 94.4 | 93.7; 97.5 | 92.1; 96.7 | 92.9; 97.2 | 94.9; 99.2 | 94.5; 98 |
| 312 | 92; 98.2 | 87.9; 95.9 | 91.7; 97.7 | 92.3; 97.7 | 92.8; 98.5 | 91.2; 98.2 | 90.4; 96.2 | 89.6; 96.5 | 100; 100 | 88.6; 96.1 | 89.4; 97.7 | 87.9; 96.9 | 91.2; 99 | 89.9; 97.7 | 91.5; 97.2 | 90.4; 95.4 | 89; 94.2 |
| 313 | 90.7; 96.9 | 95.8; 98.7 | 90.4; 96.4 | 90.4; 95.9 | 89.9; 95.9 | 92.8; 96.4 | 87.3; 94.2 | 91.1; 94.7 | 88.6; 96.1 | 100; 100 | 83.2; 94.6 | 82.4; 93.5 | 94.8; 97.2 | 92.3; 96.4 | 89.9; 95.9 | 88.3; 94.2 | 87.7; 93.2 |
| 314 | 86.6; 96.6 | 82.2; 94.1 | 86.3; 96.1 | 87.1; 95.9 | 86.6; 96.6 | 85.8; 96.9 | 84.3; 94.9 | 84.3; 95.2 | 89.4; 97.7 | 83.2; 94.6 | 100; 100 | 96.4; 99 | 85.3; 97.2 | 84.5; 96.4 | 87.1; 96.1 | 85; 94.4 | 83.7; 93.2 |
| 315 | 85.5; 95.9 | 81.4; 93 | 85.3; 95.4 | 85.5; 95.1 | 85.5; 95.9 | 84.8; 96.1 | 83.3; 94.2 | 83.3; 94.4 | 87.9; 96.9 | 82.4; 93.5 | 96.4; 99 | 100; 100 | 84.5; 96.1 | 83.7; 95.4 | 85.8; 95.1 | 84; 93.7 | 82.7; 92.5 |
| 486 | 92.8; 99.2 | 94.1; 96.9 | 92.5; 98.7 | 92.5; 98.2 | 92.5; 98.7 | 95.4; 99.2 | 89.3; 96.7 | 93.7; 97.5 | 91.2; 99 | 94.8; 97.2 | 85.3; 97.2 | 84.5; 96.1 | 100; 100 | 94.6; 98.7 | 92; 98.2 | 90.4; 96.5 | 89.7; 95.5 |
| 487 | 92.3; 98.5 | 92.3; 95.6 | 92; 97.9 | 93; 97.9 | 92.3; 97.9 | 94.1; 98.5 | 89.6; 95.9 | 92.1; 96.7 | 89.9; 97.7 | 92.3; 96.4 | 84.5; 96.4 | 83.7; 95.4 | 94.6; 98.7 | 100; 100 | 92.5; 97.9 | 91.4; 96.2 | 90.2; 95.2 |
| 488 | 96.1; 98.2 | 88.4; 95.1 | 96.1; 98.2 | 96.4; 98.2 | 96.4; 98.5 | 94.6; 99 | 93.9; 96.5 | 92.9; 97.2 | 91.5; 97.2 | 89.9; 95.9 | 87.1; 96.1 | 85.8; 95.1 | 92; 98.2 | 92.5; 97.9 | 100; 100 | 95.9; 97.5 | 94.2; 96 |
| 489 | 94.9; 97 | 87.3; 93.4 | 94.9; 97 | 95.7; 97 | 94.9; 97.2 | 93.4; 97.5 | 96.5; 98.5 | 94.9; 99.2 | 90.4; 95.4 | 88.3; 94.2 | 85; 94.4 | 84; 93.7 | 90.4; 96.5 | 91.4; 96.2 | 95.9; 97.5 | 100; 100 | 96.2; 98.5 |
| 490 | 92.7; 95.5 | 86.2; 92.5 | 92.7; 95.5 | 93.5; 95.5 | 93.2; 95.5 | 92.7; 96.2 | 94.2; 97 | 94.5; 98 | 89; 94.2 | 87.7; 93.2 | 83.7; 93.2 | 82.7; 92.5 | 89.7; 95.5 | 90.2; 95.2 | 94.2; 96 | 96.2; 98.5 | 100; 100 |

Table 23: Pairwise global identity and similarity analyses between all members of MBI4 family tree were calculated using EMBOSS-6.0.1 Needleman-Wunsch algorithm with all parameters carrying default values, except for two that were modified as follows: gapopen = 8, gapextend = 2. Global similarity calculations further utilized BLOSUM62 matrix. Upper value is identity; lower value is similarity;

TABLE 24

MBI22 Family Global Identity; Global Similarity (SEQ ID NOs 257-387)

| SEQ ID NO | 257 | 284 | 285 | 377 | 378 | 379 | 380 | 381 | 382 | 383 | 384 | 385 | 386 | 387 |
|---|---|---|---|---|---|---|---|---|---|---|---|---|---|---|
| 257 | 100; 100 | 90.4; 97.8 | 84.5; 95.4 | 99.3; 99.8 | 97.4; 99.7 | 95.1; 99 | 93.2; 98.6 | 91.3; 98.1 | 90.4; 97.9 | 85; 95.9 | 84; 95.4 | 83.9; 94.9 | 82; 94.5 | 81.1; 91.8 |
| 284 | 90.4; 97.8 | 100; 100 | 85.4; 96.1 | 90.2; 98 | 90.5; 98 | 92.6; 98.1 | 91.6; 98 | 95.3; 99.1 | 99; 99.9 | 85.6; 96.2 | 84.5; 95.7 | 84.2; 95.4 | 81.2; 94.2 | 81.8; 92.4 |
| 285 | 84.5; 95.4 | 85.4; 96.1 | 100; 100 | 84.4; 95.6 | 84.5; 95.5 | 85; 95.5 | 85; 95.5 | 85.7; 95.9 | 85.6; 96.3 | 96.6; 99.3 | 93.8; 99.3 | 93.6; 98.8 | 83.2; 95.4 | 95.6; 96 |
| 377 | 99.3; 99.8 | 90.2; 98 | 84.4; 95.6 | 100; 100 | 97.2; 99.9 | 95; 99.2 | 92.9; 98.9 | 91.3; 98.3 | 90.2; 98.1 | 84.9; 96.1 | 83.9; 95.6 | 83.8; 95.1 | 81.9; 94.5 | 81; 92 |
| 378 | 97.4; 99.7 | 90.5; 98 | 84.5; 95.5 | 97.2; 99.9 | 100; 100 | 94.7; 99.1 | 93.2; 98.9 | 90.6; 98.3 | 90.3; 98.1 | 85.2; 96 | 84.1; 95.5 | 83.9; 95.1 | 81.6; 94.3 | 81.1; 91.9 |
| 379 | 95.1; 99 | 92.6; 98.1 | 85; 95.5 | 95; 99.2 | 94.7; 99.1 | 100; 100 | 93.2; 98.3 | 93; 98.2 | 92.9; 98.2 | 85.7; 95.7 | 84; 95.1 | 83.6; 94.8 | 81.2; 94.2 | 81.5; 91.9 |
| 380 | 93.2; 98.6 | 91.6; 98 | 85; 95.5 | 92.9; 98.9 | 93.2; 98.9 | 93.2; 98.3 | 100; 100 | 93.2; 98.5 | 91.4; 98.1 | 85; 95.7 | 84.7; 95.4 | 84.7; 95 | 82.3; 94.4 | 81.5; 91.9 |
| 381 | 91.3; 98.1 | 95.3; 99.1 | 85.7; 95.9 | 91.3; 98.3 | 90.6; 98.3 | 93; 98.2 | 93.2; 98.5 | 100; 100 | 95.5; 99.2 | 86; 96 | 84.6; 95.7 | 84.2; 95.3 | 81.7; 94.3 | 82.1; 92.2 |
| 382 | 90.4; 97.9 | 99; 99.9 | 85.6; 96.3 | 90.2; 98.1 | 90.3; 98.1 | 92.9; 98.2 | 91.4; 98.1 | 95.5; 99.2 | 100; 100 | 86.3; 96.5 | 84.7; 95.8 | 84.3; 95.5 | 81.4; 94.4 | 82.1; 92.5 |
| 383 | 85; 95.9 | 85.6; 96.2 | 96.6; 99.3 | 84.9; 96.1 | 85.2; 96 | 85.7; 95.7 | 85.6; 95.7 | 86; 96 | 86.3; 96.5 | 100; 100 | 95; 99.4 | 94.7; 99 | 83.2; 95.3 | 92.8; 95.4 |
| 384 | 84; 95.4 | 84.5; 95.7 | 93.8; 99.3 | 83.9; 95.6 | 84.1; 95.5 | 84; 95.1 | 85; 95.4 | 84.6; 95.7 | 84.7; 95.8 | 95; 99.4 | 100; 100 | 99; 99.7 | 82.1; 95.1 | 90.2; 95.4 |
| 385 | 83.9; 94.9 | 84.2; 95.4 | 93.6; 98.8 | 83.8; 95.1 | 83.9; 95.1 | 83.6; 94.8 | 84.7; 95 | 84.2; 95.3 | 84.3; 95.5 | 94.7; 99 | 99; 99.7 | 100; 100 | 81.7; 94.7 | 90; 94.9 |
| 386 | 82; 94.5 | 81.2; 94.2 | 83.2; 95.4 | 81.9; 94.5 | 81.6; 94.3 | 81.2; 94.2 | 82.3; 94.4 | 81.7; 94.3 | 81.4; 94.4 | 83.2; 95.3 | 82.1; 95.1 | 81.7; 94.7 | 100; 100 | 79.8; 91.6 |

TABLE 24-continued

MBI22 Family Global Identity; Global Similarity (SEQ ID NOs 257-387)

| | SEQ ID NO | | | | | | | | | | | | | |
|---|---|---|---|---|---|---|---|---|---|---|---|---|---|---|
| | 257 | 284 | 285 | 377 | 378 | 379 | 380 | 381 | 382 | 383 | 384 | 385 | 386 | 387 |
| 387 | 81.1; 91.8 | 81.8; 92.4 | 95.6; 96 | 81; 92 | 81.1; 91.9 | 81.5; 91.9 | 81.5; 91.9 | 82.1; 92.2 | 82.1; 92.5 | 92.8; 95.4 | 90.2; 95.4 | 90; 94.9 | 79.8; 91.6 | 100; 100 |
| 457 | 90.6; 97.8 | 99; 99.9 | 85.7; 96.1 | 90.4; 98 | 90.5; 98 | 92.8; 98.1 | 91.6; 98.1 | 95.5; 99.2 | 99.2; 100 | 86.1; 96.2 | 84.9; 95.7 | 84.4; 95.3 | 81.4; 94.3 | 82.1; 92.4 |
| 458 | 90.5; 97.8 | 98.9; 99.9 | 85.7; 96.1 | 90.3; 98 | 90.4; 98 | 92.7; 98.1 | 91.8; 98.1 | 95.4; 99.2 | 99.1; 100 | 86.2; 96.2 | 84.9; 95.7 | 84.4; 95.3 | 81.3; 94.3 | 82.1; 92.4 |
| 459 | 90.6; 97.9 | 97.8; 99.8 | 85.7; 96.1 | 90.4; 98.1 | 90.2; 98.1 | 92.6; 98.2 | 91.9; 98.1 | 95.3; 99.2 | 98; 99.9 | 86.2; 96.2 | 84.9; 95.7 | 84.4; 95.3 | 81.5; 94.4 | 82.2; 92.3 |
| 460 | 93.3; 98.6 | 91.2; 98 | 85.2; 95.5 | 93; 98.9 | 93.3; 98.9 | 92.5; 98.3 | 98; 99.8 | 92.5; 98.5 | 91; 98.1 | 85.3; 95.7 | 84.6; 95.4 | 84.4; 95 | 82.9; 94.4 | 81.7; 91.9 |
| 461 | 85.6; 95.2 | 88; 95.9 | 93.9; 99.1 | 85.5; 95.4 | 85.4; 95.3 | 86; 95.5 | 86.4; 95.6 | 87.4; 95.9 | 88.3; 96.1 | 95; 99.2 | 93.5; 99 | 93.2; 98.5 | 82.5; 95 | 90.3; 95.2 |
| 462 | 85.4; 95.5 | 87.8; 96.2 | 93.8; 99.1 | 85.3; 95.7 | 85.2; 95.6 | 85.8; 95.8 | 86.3; 96 | 87.2; 96 | 88.1; 96.5 | 94.8; 99.2 | 93.2; 99 | 92.9; 98.5 | 82.6; 95.1 | 90.2; 95.2 |
| 463 | 84.9; 95.2 | 85.9; 95.9 | 96.7; 99.4 | 84.8; 95.4 | 85.1; 95.3 | 85.6; 95.4 | 85.5; 95.4 | 86.1; 95.7 | 86; 96.1 | 98.6; 99.7 | 94.8; 99.3 | 94.5; 98.9 | 82.7; 95.3 | 92.8; 95.6 |
| 464 | 84.3; 95.5 | 85; 95.7 | 96.1; 99.6 | 84.2; 95.7 | 84.5; 95.5 | 85; 95.2 | 85.3; 95.3 | 85.2; 95.7 | 85.3; 95.9 | 95.8; 99.1 | 94.9; 99.2 | 94.6; 98.8 | 82.8; 95.1 | 92.3; 95.8 |
| 465 | 81.8; 94.3 | 81.1; 94.3 | 83; 95.4 | 81.8; 94.5 | 81.5; 94.3 | 81.2; 94.2 | 82.1; 94.4 | 81.6; 94.3 | 81.3; 94.5 | 83; 95.4 | 81.9; 95.2 | 81.5; 94.8 | 99.4; 100 | 79.6; 91.6 |
| 466 | 81.4; 94.4 | 80.9; 94.4 | 82.8; 95.3 | 81.3; 94.4 | 81; 94.2 | 80.8; 94.2 | 81.9; 94.5 | 81.3; 94.3 | 81.1; 94.6 | 82.7; 95.4 | 81.7; 95.2 | 81.3; 94.8 | 99.2; 99.9 | 79.4;91.5 91.5 |
| 467 | 83.9; 95.4 | 84.5; 95.5 | 96; 99.4 | 83.8; 95.6 | 84.1; 95.5 | 84.2; 95 | 84.9; 95.2 | 85.1; 95.6 | 84.7; 95.8 | 95.7; 99 | 95; 99 | 94.7; 98.5 | 82.5; 95 | 92.2; 95.6 |
| 468 | 81.2; 91.7 | 82; 92.4 | 93.3; 95.8 | 81.1; 91.9 | 81.2; 91.8 | 81.5; 91.9 | 81.6; 91.9 | 82.2; 92.2 | 82; 92.6 | 93.7; 95.7 | 91.2; 95.7 | 91; 95.2 | 79.6; 91.8 | 97; 99.8 |
| 469 | 81.6; 92.1 | 81.8; 92.6 | 90.7; 95.4 | 81.3; 92.3 | 81.7; 92.1 | 81.5; 92.1 | 82.2; 92.3 | 81.8; 92.7 | 82.1; 92.8 | 91.3; 95.3 | 91.2; 95.4 | 90.9; 95 | 79.2; 91.6 | 93.8; 98.9 |
| 470 | 71.4; 80.1 | 72.3; 80.8 | 84.1; 84.2 | 71.3; 80.3 | 71.4; 80.2 | 71.6; 80.3 | 71.5; 80.3 | 72.5; 80.7 | 72.5; 81 | 81.1; 83.6 | 78.8; 83.6 | 78.6; 83.1 | 70.2; 80.2 | 80.5; 80.8 |
| 471 | 85.2; 96.2 | 84.8; 95.7 | 80.1; 94.9 | 85.2; 96.4 | 85.2; 96.4 | 84.9; 96.2 | 84.5; 96.2 | 84.6; 95.5 | 85; 95.8 | 80.5; 94.8 | 80; 94.6 | 79.6; 94.2 | 79.2; 94.5 | 77.1; 91.1 |

Table 24: Pairwise global identity and similarity analyses between all members of MBI22 family tree were calculated using EMBOSS-6.0.1 Needleman-Wunsch algorithm with all parameters carrying default values, except for two that were modified as follows: gapopen = 8, gapextend = 2. Global similarity calculations further utilized BLOSUM62 matrix. Upper value is identity; lower value is similarity;

TABLE 25

MBI22 Family Global Identity; Global Similarity (SEQ ID NOs 457-471)

| | SEQ ID NO | | | | | | | | | | | | | | |
|---|---|---|---|---|---|---|---|---|---|---|---|---|---|---|---|
| | 457 | 458 | 459 | 460 | 461 | 462 | 463 | 464 | 465 | 466 | 467 | 468 | 469 | 470 | 471 |
| 257 | 90.6; 97.8 | 90.5; 97.8 | 90.6; 97.9 | 93.3; 98.6 | 85.6; 95.2 | 85.4; 95.5 | 84.9; 95.2 | 84.3; 95.5 | 81.8; 94.3 | 81.4; 94.4 | 83.9; 95.4 | 81.2; 91.7 | 81.6; 92.1 | 71.4; 80.1 | 85.2; 96.2 |
| 284 | 99; 99.9 | 98.9; 99.9 | 97.8; 99.8 | 91.2; 98 | 88; 95.9 | 87.8; 96.2 | 85.9; 95.9 | 85; 95.7 | 81.1; 94.3 | 80.9; 94.4 | 84.5; 95.5 | 82; 92.4 | 81.8; 92.6 | 72.3; 80.8 | 84.8; 95.7 |
| 285 | 85.7; 96.1 | 85.7; 96.1 | 85.7; 96.1 | 85.2; 95.5 | 93.9; 99.1 | 93.8; 99.1 | 96.7; 99.4 | 96.1; 99.6 | 83; 95.4 | 82.8; 95.3 | 96; 99.4 | 93.3; 95.8 | 90.7; 95.4 | 84.1; 84.2 | 80.1; 94.9 |
| 377 | 90.4; 98 | 90.3; 98 | 90.4; 98.1 | 93; 98.9 | 85.5; 95.4 | 85.3; 95.7 | 84.8; 95.4 | 84.2; 95.7 | 81.8; 94.5 | 81.3; 94.4 | 83.8; 95.6 | 81.1; 91.9 | 81.3; 92.3 | 71.3; 80.3 | 85.2; 96.4 |
| 378 | 90.5; 98 | 90.4; 98 | 90.2; 98.1 | 93.3; 98.9 | 85.4; 95.3 | 85.2; 95.6 | 85.1; 95.3 | 84.5; 95.5 | 81; 94.3 | 84.1; 94.2 | 81.2; 95.5 | 81.7; 91.8 | 71.4; 92.1 | 80.2 | 85.2; 96.4 |
| 379 | 92.8; 98.1 | 92.7; 98.1 | 92.6; 98.2 | 92.5; 98.3 | 86; 95.5 | 85.8; 95.8 | 85.6; 95.4 | 85; 95.2 | 81.2; 94.2 | 80.8; 94.2 | 84.2; 95 | 81.5; 91.9 | 81.5; 92.1 | 71.6; 80.3 | 84.9; 96.2 |
| 380 | 91.6; 98.1 | 91.8; 98.1 | 91.9; 98.1 | 98; 99.8 | 86.4; 95.6 | 86.3; 96 | 85.5; 95.4 | 85.3; 95.3 | 82.1; 94.4 | 81.9; 94.5 | 84.9; 95.2 | 81.6; 91.9 | 82.2; 92.3 | 71.5; 80.3 | 84.5; 96.2 |
| 381 | 95.5; 99.2 | 95.4; 99.2 | 95.3; 99.2 | 92.5; 98.5 | 87.4; 95.9 | 87.2; 96 | 86.1; 95.7 | 85.2; 95.7 | 81.6; 94.3 | 81.3; 94.3 | 85.1; 95.6 | 82.2; 92.2 | 81.8; 92.7 | 72.5; 80.7 | 84.6; 95.5 |
| 382 | 99.2; 100 | 99.1; 100 | 98; 99.9 | 91; 98.1 | 88.3; 95.9 | 88.1; 96 | 86; 95.7 | 85.3; 95.7 | 81.3; 94.3 | 81.1; 94.6 | 84.7; 95.6 | 82; 92.2 | 82.1; 92.7 | 72.5; 81 | 85; 95.8 |
| 383 | 86.1; 96.2 | 86.2; 96.2 | 86.2; 96.2 | 85.3; 95.7 | 95; 99.2 | 94.8; 99.2 | 98.6; 99.7 | 95.8; 99.1 | 83; 95.4 | 82.7; 95.4 | 95.7; 99 | 93.7; 95.7 | 91.3; 95.3 | 81.1; 83.6 | 80.5; 94.8 |
| 384 | 84.9; 95.7 | 84.9; 95.7 | 84.9; 95.7 | 84.6; 95.4 | 93.5; 99 | 93.2; 99 | 94.8; 99.3 | 94.9; 99.2 | 81.9; 95.2 | 81.7; 95.2 | 95; 99 | 91.2; 95.7 | 91.2; 95.4 | 78.8; 83.6 | 80; 94.6 |
| 385 | 84.4; 95.3 | 84.4; 95.3 | 84.4; 95.3 | 84.4; 95 | 93.2; 98.5 | 92.9; 98.5 | 94.5; 98.9 | 94.6; 98.8 | 81.5; 94.8 | 81.3; 94.8 | 94.7; 98.5 | 91; 95.2 | 90.9; 95 | 78.6; 83.1 | 79.6; 94.2 |
| 386 | 81.4; 94.3 | 81.3; 94.3 | 81.5; 94.4 | 82.9; 94.4 | 82.5; 95 | 82.6; 95.1 | 82.7; 95.3 | 82.8; 95.1 | 99.4; 100 | 99.2; 99.9 | 82.5; 95 | 79.6; 91.8 | 79.2; 91.6 | 70.2; 80.2 | 79.2; 94.5 |

TABLE 25-continued

MBI22 Family Global Identity; Global Similarity (SEQ ID NOs 457-471)

| SEQ ID NO | 457 | 458 | 459 | 460 | 461 | 462 | 463 | 464 | 465 | 466 | 467 | 468 | 469 | 470 | 471 |
|---|---|---|---|---|---|---|---|---|---|---|---|---|---|---|---|
| 387 | 82.1; 92.4 | 82.1; 92.4 | 82.2; 92.3 | 81.7; 91.9 | 90.3; 95.2 | 90.2; 95.2 | 92.8; 95.6 | 92.3; 95.8 | 79.6; 91.6 | 79.4 91.5 | 92.2; 95.6 | 97; 99.8 | 93.8; 98.9 | 80.5; 80.8 | 77.1; 91.1 |
| 457 | 100; 100 | 99.7; 100 | 97.8; 99.9 | 91.2; 98.1 | 88.2; 95.9 | 88; 96.2 | 86.3; 95.9 | 85.6; 95.7 | 81.3; 94.4 | 81.1 94.5 | 85.1; 95.6 | 82.3; 92.4 | 82.4; 92.6 | 72.6; 80.8 | 84.9; 95.8 |
| 458 | 99.7; 100 | 100; 100 | 97.9; 99.9 | 91.3; 98.1 | 88.2; 95.9 | 88; 96.2 | 86.3; 95.9 | 85.7; 95.7 | 81.2; 94.4 | 81; 94.5 | 85.1; 95.6 | 82.3; 92.4 | 82.4; 92.6 | 72.6; 80.8 | 84.9; 95.8 |
| 459 | 97.8; 99.9 | 97.9; 99.9 | 100; 100 | 91.4; 98.1 | 89.1; 96.1 | 89.1; 96.5 | 86.3; 95.9 | 85.4; 95.7 | 81.4; 94.5 | 81.3 94.5 | 85; 95.5 | 82.3; 92.4 | 82.2; 92.5 | 72.6; 80.9 | 84.8; 95.8 |
| 460 | 91.2; 98.1 | 91.3; 98.1 | 91.4; 98.1 | 100; 100 | 85.6; 95.5 | 85.5; 95.8 | 85.3; 95.4 | 85.1; 95.3 | 82.7; 94.1 | 82.4 94.4 | 84.5; 95.1 | 81.5; 91.9 | 82.3; 92.2 | 71.8; 80.3 | 84.8; 96.2 |
| 461 | 88.2; 95.9 | 88.2; 95.9 | 89.1; 96.1 | 85.6; 95.5 | 100; 100 | 99.2; 99.8 | 95; 99.1 | 94; 99 | 82.4; 95 | 82.5 95.1 | 93.6; 98.8 | 90.9; 95.3 | 90.3; 95.3 | 79; 83.4 | 80.7; 94.8 |
| 462 | 88; 96.2 | 88; 96.2 | 89.1; 96.5 | 85.5; 95.8 | 99.2; 99.8 | 100; 100 | 94.9; 99.1 | 93.8; 99 | 82.5; 95.1 | 82.7 95.1 | 93.4; 98.8 | 90.8; 95.3 | 90; 95.3 | 78.9; 83.4 | 80.2; 95 |
| 463 | 86.3; 95.9 | 86.3; 95.9 | 86.3; 95.9 | 85.3; 95.4 | 95; 99.1 | 94.9; 99.1 | 100; 100 | 95.9; 99.2 | 82.6; 95.3 | 82.4 95.3 | 96; 99 | 94.2; 95.8 | 91.3; 95.2 | 81.3; 83.7 | 80.1; 94.5 |
| 464 | 85.6; 95.7 | 85.7; 95.7 | 85.4; 95.7 | 85.1; 95.3 | 94; 99 | 93.8; 99 | 95.9; 99.2 | 100; 100 | 82.4; 95.4 | 82.5 95.1 | 98.1; 99.5 | 92.5; 95.6 | 92.3; 95.3 | 80.9; 83.8 | 79.8; 94.5 |
| 465 | 81.3; 94.4 | 81.2; 94.4 | 81.4; 94.5 | 82.7; 94.1 | 82.4; 95 | 82.5; 95.1 | 82.6; 95.3 | 82.4; 95.4 | 100; 100 | 99; 99.9 | 82.1; 95.2 | 79.5; 91.8 | 79; 91.4 | 70; 80.2 | 79; 94.6 |
| 466 | 81.1; 94.5 | 81; 94.5 | 81.3; 94.5 | 82.4; 94.4 | 82.5; 95.1 | 82.7; 95.1 | 82.4; 95.3 | 82.5; 95.1 | 99; 99.9 | 100; 100 | 82.1; 95 | 79.3; 91.8 | 78.8; 91.6 | 69.8; 80.1 | 78.9; 94.4 |
| 467 | 85.1; 95.6 | 85.1; 95.6 | 85; 95.5 | 84.5; 95.1 | 93.6; 98.8 | 93.4; 98.8 | 96; 99 | 98.1; 99.5 | 82.1; 95.2 | 82.1 95 | 100; 100 | 92.4; 95.4 | 92; 95.2 | 80.8; 83.6 | 79.7; 94.6 |
| 468 | 82.3; 92.4 | 82.3; 92.4 | 82.3; 92.4 | 81.5; 91.9 | 90.9; 95.3 | 90.8; 95.3 | 94.2; 95.8 | 92.5; 95.6 | 79.5; 91.8 | 79.3 91.8 | 92.4; 95.4 | 100; 100 | 94.4; 98.9 | 78.5; 80.7 | 76.6; 91.1 |
| 469 | 82.4; 92.6 | 82.4; 92.6 | 82.2; 92.5 | 82.3; 92.2 | 90.3; 95.3 | 90; 95.3 | 91.3; 95.2 | 92.3; 95.3 | 79; 91.4 | 78.8 91.6 | 92; 95.2 | 94.4; 98.9 | 100; 100 | 75.9; 80.2 | 77.3; 91.3 |
| 470 | 72.6; 80.8 | 72.6; 80.8 | 72.6; 80.9 | 71.8; 80.3 | 79; 83.4 | 78.9; 83.4 | 81.3; 83.7 | 80.9; 83.8 | 70; 80.2 | 69.8 80.1 | 80.8; 83.6 | 78.5; 80.7 | 75.9; 80.2 | 100; 100 | 67.3; 79.8 |
| 471 | 84.9; 95.8 | 84.9; 95.8 | 84.8; 95.8 | 84.8; 96.2 | 80.7; 94.8 | 80.2; 95 | 80.1; 94.5 | 79.8; 94.5 | 79; 94.6 | 78.9 94.4 | 79.7; 94.6 | 76.6; 91.1 | 77.3; 91.3 | 67.3; 79.8 | 100; 100 |

Table 25: Pairwise global identity and similarity analyses between all members of MBI22 family tree were calculated using EMBOSS-6.0.1 Needleman-Wunsch algorithm with all parameters carrying default values, except for two that were modified as follows: gapopen = 8, gapextend = 2. Global similarity calculations further utilized BLOSUM62 matrix. Upper value is identity; lower value is similarity;

TABLE 26

MBI27 Family Global Identity; Global Similarity (SEQ ID NOs 259-395)

| SEQ ID NO | 259 | 286 | 287 | 288 | 289 | 290 | 291 | 292 | 293 | 294 | 295 | 393 | 394 | 395 |
|---|---|---|---|---|---|---|---|---|---|---|---|---|---|---|
| 259 | 100; 100 | 88.3; 95.6 | 87.4; 96.2 | 87; 96.1 | 86; 94.6 | 82.5; 94 | 76.5; 91 | 72.2; 88.1 | 34.6; 56.1 | 39.8; 63.1 | 43.3; 65.7 | 87.1; 96.2 | 85.2; 93.8 | 84.7; 94.6 |
| 286 | 88.3; 95.6 | 100; 100 | 87.9; 96.3 | 87; 95.8 | 87.9; 95.8 | 83.9; 94.7 | 77.1; 92.3 | 73.4; 89.1 | 35.5; 56.8 | 42; 64.7 | 43.1; 64.7 | 87; 96.5 | 91.2; 96.3 | 86.4; 95.8 |
| 287 | 87.4; 96.2 | 87.9; 96.3 | 100; 100 | 94.7; 99.1 | 87.6; 95.5 | 84.6; 95.6 | 76.4; 91.4 | 72; 88.8 | 34; 55.5 | 39.9; 62.6 | 42.6; 64.1 | 88.7; 97.4 | 84.5; 94.1 | 85.9; 95.6 |
| 288 | 87; 96.1 | 87; 95.8 | 94.7; 99.1 | 100; 100 | 86.6; 95 | 84.5; 94.7 | 76.9; 90.8 | 72.4; 88.3 | 34.4; 54.6 | 39.8; 63.1 | 42.9; 64.4 | 87.7; 97.1 | 84.9; 94 | 85.1; 94.7 |
| 289 | 86; 94.6 | 87.9; 95.8 | 87.6; 95.5 | 86.6; 95 | 100; 100 | 83; 94.4 | 77.2; 90.7 | 72.6; 87.9 | 36.4; 59.1 | 40.9; 64 | 43.7; 64.8 | 86.1; 95.8 | 85.4; 94 | 83.8; 94.4 |
| 290 | 82.5; 94 | 83.9; 94.7 | 84.6; 95.6 | 84.5; 94.7 | 83; 94.4 | 100; 100 | 75.2; 90.2 | 70.1; 87.5 | 33.9; 55.3 | 40.2; 63.7 | 42.4; 66.4 | 89.5; 97.2 | 81.6; 92.7 | 82.9; 94.3 |
| 291 | 76.5; 91 | 77.1; 92.3 | 76.4; 91.4 | 76.9; 90.8 | 77.2; 90.7 | 75.2; 90.2 | 100; 100 | 81.5; 91.9 | 35; 58.2 | 38.7; 63.8 | 44; 67.4 | 76.4; 91.7 | 76.5; 89.5 | 76.2; 90.5 |
| 292 | 72.2; 88.1 | 73.4; 89.1 | 72; 88.8 | 72.4; 88.3 | 72.6; 87.9 | 70.1; 87.5 | 81.5; 91.9 | 100; 100 | 31; 52.5 | 39.6; 65.5 | 41.1; 62.8 | 71.8; 88.6 | 72.1; 87.1 | 72.1; 88.8 |
| 293 | 34.6; 56.1 | 35.5; 56.8 | 34; 55.5 | 34.4; 54.6 | 36.4; 59.1 | 33.9; 55.3 | 35; 58.2 | 31; 52.5 | 100; 100 | 37.1; 58.2 | 34.5; 56.4 | 34.6; 54.9 | 36.6; 58.5 | 35.6; 55.6 |
| 294 | 40.1; 64.2 | 42; 64.7 | 39.9; 62.6 | 39.8; 63.1 | 40.9; 64 | 40.2; 63.7 | 38.7; 63.8 | 39.6; 65.5 | 37.1; 58.2 | 100; 100 | 43.4; 66.2 | 39.9; 62 | 39.8; 63.7 | 40.6; 61.9 |
| 295 | 43.3; 65.7 | 43.1; 64.7 | 42.6; 64.1 | 42.9; 64.4 | 43.7; 64.8 | 42.4; 66.4 | 44; 67.4 | 41.1; 62.8 | 34.5; 56.4 | 43.4; 66.2 | 100; 100 | 43.5; 66.6 | 42.2; 62.5 | 42.4; 65.5 |
| 393 | 87.1; 96.2 | 87; 96.5 | 88.7; 97.4 | 87.7; 97.1 | 86.1; 95.8 | 89.5; 97.2 | 76.4; 91.7 | 71.8; 88.6 | 34.6; 54.9 | 39.9; 62 | 43.5; 66.6 | 100; 100 | 84.8; 94.3 | 86.4; 95.8 |
| 394 | 85.2; 93.8 | 91.2; 96.3 | 84.5; 94.1 | 84.9; 94 | 85.4; 94 | 81.6; 92.7 | 76.5; 89.5 | 72.1; 87.1 | 36.6; 58.5 | 39.8; 63.7 | 42.2; 62.5 | 84.8; 94.3 | 100; 100 | 83.8; 93.7 |
| 395 | 84.7; 94.6 | 86.4; 95.8 | 85.9; 95.6 | 85.1; 94.7 | 83.8; 94.4 | 82.9; 94.3 | 76.2; 90.5 | 72.1; 88.8 | 35.6; 55.6 | 40.6; 61.9 | 42.4; 65.5 | 86.4; 95.8 | 83.8; 93.7 | 100; 100 |

TABLE 26-continued

MBI27 Family Global Identity; Global Similarity (SEQ ID NOs 259-395)

| | SEQ ID NO | | | | | | | | | | | | | |
|---|---|---|---|---|---|---|---|---|---|---|---|---|---|---|
| | 259 | 286 | 287 | 288 | 289 | 290 | 291 | 292 | 293 | 294 | 295 | 393 | 394 | 395 |
| 472 | 87.3; 96.4 | 87.1; 96.6 | 96.1; 99.6 | 93.6; 99.1 | 86.7; 95.3 | 84.5; 95.6 | 76.4; 91.8 | 71.8; 89.1 | 35.2; 56.3 | 40.9; 63.4 | 44; 65.7 | 89; 97.7 | 84.2; 94.4 | 85.5; 95.8 |
| 473 | 87.5; 95 | 87.6; 95.6 | 88.5; 96.6 | 88.2; 96.4 | 86.9; 95.2 | 85.6; 95.3 | 77.1; 91.3 | 73; 88.6 | 35.6; 57.5 | 39.9; 63.2 | 44.6; 66.1 | 88.6; 97.1 | 84.7; 93.4 | 85.3; 95.8 |
| 474 | 87.8; 95 | 87.6; 95.5 | 88.6; 96.6 | 88.3; 96.4 | 87; 95.2 | 85.7; 95.3 | 77.1; 91.1 | 73.2; 88.8 | 36; 57.9 | 40.2; 63.2 | 44.8; 66.1 | 88.8; 97.1 | 84.7; 93.3 | 85.4; 95.6 |
| 475 | 76.4; 90.8 | 76.8; 92.1 | 76.2; 91.4 | 76.8; 90.8 | 77.2; 90.5 | 74.9; 90.1 | 99.7; 99.9 | 81.2; 91.8 | 35; 58.2 | 38.7; 63.8 | 43.9; 67.4 | 76.1; 91.5 | 76.2; 89.4 | 75.9; 90.4 |
| 476 | 76.2; 90.8 | 76.8; 92 | 76.2; 91.2 | 76.8; 90.7 | 77.2; 90.4 | 75.2; 90.1 | 98.2; 99.7 | 80.8; 91.5 | 35; 58 | 39.4; 64.3 | 43.4; 66.9 | 76.2; 91.4 | 75.9; 89.4 | 76.1; 90.4 |
| 477 | 76.2; 90.7 | 76.6; 92 | 75.5; 91.1 | 76.4; 90.4 | 76.5; 90.4 | 74.2; 89.8 | 97.2; 99 | 81.4; 91.6 | 34.4; 57.9 | 38.7; 62.8 | 43.8; 66.7 | 75.6; 91.1 | 76.2; 89.4 | 75.6; 90.7 |
| 478 | 73.7; 89.2 | 74.8; 90.8 | 74.3; 89.5 | 74.3; 88.9 | 74.3; 88.8 | 72; 88.9 | 89.7; 97.1 | 78.5; 90.3 | 32.8; 55.9 | 38.7; 61.5 | 41.5; 65.5 | 73.6; 89.5 | 73.4; 88.3 | 74.1; 89.5 |
| 479 | 69.7; 86 | 71.5; 87.7 | 70.7; 86.1 | 71.1; 85.6 | 70.5; 85.4 | 69.6; 85.7 | 86; 93.8 | 75.5; 86.9 | 33.1; 55.2 | 39.3; 60.4 | 41.5; 64 | 70.1; 86.3 | 70.3; 85.2 | 70.7; 86.3 |
| 480 | 73.9; 89.6 | 75.2; 90.9 | 73.5; 89.9 | 74; 89.6 | 74.8; 89.8 | 72.7; 88.6 | 84.4; 93.2 | 83.3; 92.5 | 33.8; 56.1 | 39.1; 62.9 | 42.3; 64.7 | 73.7; 90.2 | 76.3; 91.1 | 74.9; 90.9 |
| 481 | 65.7; 80.9 | 66.1; 81.8 | 65.8; 81.5 | 66.3; 81 | 66.3; 80.4 | 64.5; 80.4 | 74.9; 84.6 | 82.8; 87.4 | 27.5; 46.7 | 34.3; 57.2 | 36.2; 56.9 | 65.7; 81 | 65.2; 79.9 | 65.3; 81 |
| 482 | 34.4; 56.4 | 36.1; 56 | 34.9; 55.6 | 35.3; 56.5 | 36.4; 58.6 | 35.5; 55.9 | 35.3; 58.6 | 31.9; 53 | 95.6; 98.9 | 37.2; 56.9 | 34.7; 54.7 | 35.3; 55.9 | 36.3; 58.1 | 35.8; 56.8 |
| 483 | 35.1; 56.6 | 36.1; 55.8 | 34.2; 55.6 | 35.2; 56.3 | 34.8; 55 | 35.5; 57 | 35.1; 57.1 | 33.8; 54.4 | 87.4; 96.8 | 37.4; 57 | 34.8; 55.8 | 34; 54.7 | 35.4; 56.1 | 34.4; 54.9 |
| 484 | 35.4; 56.5 | 37.8; 56.9 | 34.9; 55.7 | 36; 56.2 | 35; 55.4 | 36.6; 57.6 | 35.3; 57.6 | 33.6; 54.2 | 86.4; 96.4 | 38.2; 57 | 35.7; 55.6 | 35.6; 56 | 37.1; 56.6 | 36.1; 55.9 |
| 485 | 35.4; 56 | 36.5; 56.1 | 34.4; 55.2 | 35.2; 55.5 | 34.7; 54.1 | 35.5; 56.7 | 34.8; 56.6 | 32.5; 53.8 | 85.7; 94.4 | 37.6; 56.6 | 35; 54.7 | 34.3; 54.2 | 35.8; 56 | 35.3; 55.4 |

Table 26: Pairwise global identity and similarity analyses between all members of MBI27 family tree were calculated using EMBOSS-6.0.1 Needleman-Wunsch algorithm with all parameters carrying default values, except for two that were modified as follows: gapopen = 8, gapextend = 2. Global similarity calculations further utilized BLOSUM62 matrix. Upper value is identity; lower value is similarity;

TABLE 27

MBI27 Family Global Identity; Global Similarity (SEQ ID NOs 472-485)

| | SEQ ID NO | | | | | | | | | | | | | |
|---|---|---|---|---|---|---|---|---|---|---|---|---|---|---|
| | 472 | 473 | 474 | 475 | 476 | 477 | 478 | 479 | 480 | 481 | 482 | 483 | 484 | 485 |
| 259 | 87.3; 96.4 | 87.5; 95 | 87.8; 95 | 76.4; 90.8 | 76.2; 90.8 | 76.2; 90.7 | 73.7; 89.2 | 69.7; 86 | 73.9; 89.6 | 65.7; 80.9 | 34.4; 56.4 | 35.1; 56.6 | 35.4; 56.5 | 35.4; 56 |
| 286 | 87.1; 96.6 | 87.6; 95.6 | 87.6; 95.5 | 76.8; 92.1 | 76.8; 92 | 76.6; 92 | 74.8; 90.8 | 71.5; 87.7 | 75.2; 90.9 | 66.1; 81.8 | 36.1; 56 | 36.1; 55.8 | 37.8; 56.9 | 36.5; 56.1 |
| 287 | 96.1; 99.6 | 88.5; 96.6 | 88.6; 96.6 | 76.2; 91.4 | 76.2; 91.2 | 75.5; 91.1 | 74.3; 89.5 | 70.7; 86.1 | 73.5; 89.9 | 65.8; 81.5 | 34.9; 55.6 | 34.2; 55.6 | 34.9; 55.7 | 34.4; 55.2 |
| 288 | 93.6; 99.1 | 88.2; 96.4 | 88.3; 96.4 | 76.8; 90.8 | 76.8; 90.7 | 76.4; 90.4 | 74.3; 88.9 | 71.1; 85.6 | 74; 89.6 | 66.3; 81 | 35.3; 56.5 | 35.2; 56.3 | 36; 56.7 | 35.2; 55.5 |
| 289 | 86.7; 95.3 | 86.9; 95.2 | 87; 95.2 | 77.2; 90.5 | 77.2; 90.4 | 76.5; 90.4 | 74.3; 88.8 | 70.5; 85.4 | 74.8; 89.8 | 66.3; 80.4 | 36.4; 58.6 | 34.8; 55 | 35; 55.4 | 34.7; 54.1 |
| 290 | 84.5; 95.6 | 85.6; 95.3 | 85.7; 95.3 | 74.9; 90.1 | 75.2; 90.1 | 74.2; 89.8 | 72; 88.9 | 69.6; 85.7 | 72.7; 88.6 | 64.5; 80.4 | 35.5; 55.9 | 35.5; 57 | 36.6; 57.6 | 35.5; 56.7 |
| 291 | 76.4; 91.8 | 77.1; 91.3 | 77.1; 91.1 | 99.7; 99.9 | 98.2; 99.7 | 97.2; 99 | 89.7; 97.1 | 86; 93.8 | 84.4; 93.2 | 74.9; 84.6 | 35.3; 58.6 | 35.1; 57.1 | 35.3; 57.6 | 34.8; 56.6 |
| 292 | 71.8; 89.1 | 73; 88.6 | 73.2; 88.8 | 81.2; 91.8 | 80.8; 91.5 | 81.4; 91.6 | 78.5; 90.3 | 75.5; 86.9 | 83.3; 92.5 | 82.8; 87.4 | 31.9; 53 | 33.8; 54.4 | 33.6; 54.2 | 32.5; 53.8 |
| 293 | 35.2; 56.3 | 35.6; 57.5 | 36; 57.9 | 35; 58.2 | 35; 58 | 34.4; 57.9 | 32.8; 55.9 | 33.1; 55.2 | 33.8; 56.1 | 27.5; 46.7 | 95.6; 98.9 | 87.4; 96.8 | 86.4; 96.4 | 85.7; 94.4 |
| 294 | 40.9; 63.4 | 39.9; 63.2 | 40.2; 63.2 | 38.7; 63.8 | 39.4; 64.3 | 38.7; 62.8 | 38.7; 61.5 | 39.3; 60.4 | 39.1; 62.9 | 34.3; 57.2 | 37.2; 56.9 | 37.4; 57 | 38.2; 57 | 37.6; 56.6 |
| 295 | 44; 65.7 | 44.6; 66.1 | 44.8; 66.1 | 43.9; 67.4 | 43.4; 66.9 | 43.8; 66.7 | 41.5; 65.5 | 41.5; 64 | 42.3; 64.7 | 36.2; 56.9 | 34.7; 54.7 | 34.8; 55.8 | 35.7; 55.6 | 35; 54.7 |
| 393 | 89; 97.7 | 88.6; 97.1 | 88.8; 97.1 | 76.1; 91.5 | 76.2; 91.4 | 75.6; 91.1 | 73.6; 89.5 | 70.1; 86.3 | 73.7; 90.2 | 65.7; 81 | 35.3; 55.9 | 34; 54.7 | 35.6; 56 | 34.3; 54.2 |
| 394 | 84.2; 94.4 | 84.7; 93.4 | 84.7; 93.3 | 76.2; 91.5 | 75.9; 91.4 | 76.2; 91.1 | 73.4; 89.4 | 70.3; 85.2 | 76.3; 91.1 | 65.2; 79.9 | 36.3; 58.1 | 35.4; 56.1 | 37.1; 56.6 | 35.8; 56 |
| 395 | 85.5; 95.8 | 85.3; 95.8 | 85.4; 95.6 | 75.9; 90.4 | 76.1; 90.4 | 75.6; 90.7 | 74.1; 89.5 | 70.7; 86.3 | 74.9; 90.9 | 65.3; 81 | 35.8; 56.8 | 34.4; 54.9 | 36.1; 55.9 | 35.3; 55.4 |
| 472 | 100; 100 | 88.3; 97.1 | 88.3; 96.8 | 76.2; 91.7 | 76.2; 91.7 | 75.9; 91.5 | 74.6; 89.8 | 71; 86.7 | 73.9; 90.3 | 65.7; 81.9 | 35.5; 56.7 | 34.5; 55.5 | 35.6; 56.4 | 35.3; 55.9 |

TABLE 27-continued

MBI27 Family Global Identity; Global Similarity (SEQ ID NOs 472-485)

| | SEQ ID NO | | | | | | | | | | | | | |
|---|---|---|---|---|---|---|---|---|---|---|---|---|---|---|
| | 472 | 473 | 474 | 475 | 476 | 477 | 478 | 479 | 480 | 481 | 482 | 483 | 484 | 485 |
| 473 | 88.3; | 100; | 98.8; | 76.8; | 76.5; | 76.4; | 74.7; | 70.9; | 74.7; | 66.3; | 35.5; | 35; | 36.2; | 35.1; |
| | 97.1 | 100 | 99.6 | 91.1 | 91 | 90.8 | 89.7 | 86.3 | 89.6 | 81.5 | 57.9 | 57 | 57.3 | 57.3 |
| 474 | 88.3; | 98.8; | 100; | 76.8; | 76.5; | 76.4; | 74.8; | 70.9; | 74.7; | 66.3; | 35.8; | 35.4; | 36.7; | 35.4; |
| | 96.8 | 99.6 | 100 | 91 | 90.8 | 90.7 | 89.5 | 86 | 89.5 | 81.5 | 57.8 | 57 | 57.4 | 57.3 |
| 475 | 76.2; | 76.8; | 76.8; | 100; | 98.2; | 96.9; | 89.6; | 85.7; | 84.4; | 74.6; | 35.3; | 35.2; | 35.5; | 34.8; |
| | 91.7 | 91.1 | 91 | 100 | 99.6 | 98.8 | 96.9 | 93.7 | 93 | 84.4 | 58.3 | 58.9 | 58.4 | 56.3 |
| 476 | 76.2; | 76.5; | 76.5; | 98.2; | 100; | 96; | 88.7; | 85; | 84.1; | 73.9; | 35.1; | 35.4; | 35.7; | 36.6; |
| | 91.7 | 91 | 90.8 | 99.6 | 100 | 99 | 96.8 | 93.7 | 92.8 | 84.3 | 58 | 58.4 | 58 | 58.5 |
| 477 | 75.9; | 76.4; | 76.4; | 96.9; | 96; | 100; | 89.9; | 86; | 84.4; | 74.7; | 34; | 33.3; | 33.7; | 34.1; |
| | 91.5 | 90.8 | 90.7 | 98.8 | 99 | 100 | 97.1 | 94 | 93 | 84.3 | 57.9 | 54.7 | 54.9 | 55.5 |
| 478 | 74.6; | 74.7; | 74.8; | 89.6; | 88.7; | 89.9; | 100; | 87.8; | 81.5; | 72.3; | 33.8; | 32.7; | 34.1; | 33.4; |
| | 89.8 | 89.7 | 89.5 | 96.9 | 96.8 | 97.1 | 100 | 94.6 | 91.8 | 83.1 | 57.9 | 56.4 | 58.2 | 55 |
| 479 | 71; | 70.9; | 70.9; | 85.7; | 85; | 86; | 87.8; | 100; | 78.3; | 74.1; | 34.2; | 33.3; | 34.2; | 33.9; |
| | 86.7 | 86.3 | 86 | 93.7 | 93.7 | 94 | 94.6 | 100 | 88.3 | 85.6 | 56.5 | 56.4 | 56.6 | 55.7 |
| 480 | 73.9; | 74.7; | 74.7; | 84.4; | 84.1; | 84.4; | 81.5; | 78.3; | 100; | 76.5; | 33.7; | 34.3; | 34.7; | 33.8; |
| | 90.3 | 89.6 | 89.5 | 93 | 92.8 | 93 | 91.8 | 88.3 | 100 | 84.6 | 56.1 | 55.3 | 55.1 | 53.5 |
| 481 | 65.7; | 66.3; | 66.3; | 74.6; | 73.9; | 74.7; | 72.3; | 74.1; | 76.5; | 100; | 29.3; | 29; | 30.3; | 29.9; |
| | 81.9 | 81.5 | 81.5 | 84.4 | 84.3 | 84.3 | 83.1 | 85.6 | 84.6 | 100 | 50.4 | 48.9 | 50.1 | 49.2 |
| 482 | 35.5; | 35.5; | 35.8; | 35.3; | 35.1; | 34; | 33.8; | 34.2; | 34.2; | 29.3; | 100; | 87.2; | 86.1; | 85.7; |
| | 56.7 | 57.9 | 57.8 | 58.3 | 58 | 57.9 | 57.9 | 56.5 | 57.5 | 50.4 | 100 | 96.4 | 96 | 94 |
| 483 | 34.5; | 35; | 35.4; | 35.2; | 35.4; | 33.3; | 32.7; | 33.3; | 34.3; | 29; | 87.2; | 100; | 90.6; | 95.1; |
| | 55.5 | 57 | 57 | 58.9 | 58.4 | 54.7 | 56.4 | 56.4 | 55.3 | 48.9 | 96.4 | 100 | 97.9 | 96.8 |
| 484 | 35.6; | 36.2; | 36.7; | 35.5; | 35.7; | 33.7; | 34.1; | 34.3; | 34.7; | 30.3; | 86.1; | 90.6; | 100; | 89.8; |
| | 56.4 | 57.3 | 57.4 | 58.4 | 58 | 54.9 | 58.2 | 56.8 | 55.1 | 50.1 | 96 | 97.9 | 100 | 96.2 |
| 485 | 35.3; | 35.1; | 35.4; | 34.8; | 36.6; | 34.1; | 33.4; | 33.9; | 33.8; | 29.9; | 85.7; | 95.1; | 89.8; | 100; |
| | 55.9 | 57.3 | 57.3 | 56.3 | 58.5 | 55.5 | 55 | 55.7 | 53.5 | 49.2 | 94 | 96.8 | 96.2 | 100 |

Table 27: Pairwise global identity and similarity analyses between all members of MBI27 family tree were calculated using EMBOSS-6.0.1 Needleman-Wunsch algorithm with all parameters carrying default values, except for two that were modified as follows: gapopen = 8, gapextend = 2. Global similarity calculations further utilized BLOSUM62 matrix. Upper value is identity; lower value is similarity;

Example 5

Identification of Orthologous Sequences of Insecticidal Proteins Retaining Insecticidal Activity by Themselves Orth

TABLE 28

Homologues (i.e., orthologues) of the identified insecticidal genes/polypeptides retaining insecticidal activity by themselves

| Gene Name | Hom. to: | Source (when public - accession number is provided) | P.N. SEQ ID NO: | P.P. SEQ ID NO: | Hom. to SEQ ID NO: | % glob. Iden. | Algor. |
|---|---|---|---|---|---|---|---|
| MBI3_H34 | MBI3 | *Bacillus* Sp. | 51 | 299 | 249 | 99.2 | globlastp |
| MBI3_H19 | MBI3 | *Paenibacillus* Sp. | 52 | 300 | 249 | 98 | globlastp |
| MBI3_H35 | MBI3 | *Bacillus* Sp. | 53 | 301 | 249 | 97.2 | globlastp |
| MBI3_H36 | MBI3 | *Bacillus* Sp. | 54 | 302 | 249 | 96 | globlastp |
| MBI3_H32 | MBI3 | *Bacillus* Sp. | 55 | 303 | 249 | 94.8 | globlastp |
| MBI3_H33 | MBI3 | *Bacillus* Sp. | 56 | 304 | 249 | 93.9 | globlastp |
| MBI3_H37 | MBI3 | *Bacillus* Sp. | 57 | 305 | 249 | 92 | globlastp |
| MBI4_H76 | MBI4 | *Bacillus* Sp. | 58 | 306 | 250 | 98.7 | globlastp |
| MBI4_H77 | MBI4_H4 | *Bacillus* Sp. | 59 | 307 | 296 | 89.1 | globlastp |
| MBI4_H78 | MBI4 | *Bacillus* Sp. | 60 | 308 | 250 | 96.1 | globlastp |
| MBI4_H61 | MBI4_H4 | *Bacillus* Sp. | 61 | 309 | 296 | 91.2 | globlastp |
| MBI4_H63 | MBI4 | *Paenibacillus* Sp. | 62 | 310 | 250 | 94.2 | globlastp |
| MBI4_H2 | MBI4 | *Streptococcus* Sp. | 63 | 311 | 250 | 93.7 | globlastp |
| MBI4_H66 | MBI4 | *Bacillus* Sp. | 64 | 312 | 250 | 92 | globlastp |
| MBI4_H79 | MBI4_H4 | *Bacillus* Sp. | 65 | 313 | 296 | 95.8 | globlastp |
| MBI4_H80 | MBI4 | *Bacillus* Sp. | 66 | 314 | 250 | 86.6 | globlastp |
| MBI4_H81 | MBI4_H4 | *Bacillus* Sp. | 67 | 315 | 296 | 81.1 | globlastp |
| MBI7_H9 | MBI7 | *Bacillus* Sp. | 68 | 316 | 251 | 96.7 | globlastp |
| PUB100 | MBI7 | *Bacillus* Sp. | 69 | 317 | 251 | 95.8 | globlastp |
| MBI7_H23 | MBI7 | *Bacillus* Sp. | 70 | 318 | 251 | 94 | globlastp |
| MBI7_H37 | MBI7 | *Bacillus* Sp. | 71 | 319 | 251 | 93.4 | globlastp |
| MBI7_H52 | MBI7 | *Bacillus* Sp. | 72 | 320 | 251 | 92.1 | globlastp |
| MBI7_H59 | MBI7 | *Bacillus* Sp. | 73 | 321 | 251 | 91.1 | globlastp |
| MBI7_H69 | MBI7 | *Bacillus* Sp. | 74 | 322 | 251 | 90 | globlastp |
| MBI7_H107 | MBI7 | *Bacillus* Sp. | 75 | 323 | 251 | 89 | globlastp |
| MBI7_H111 | MBI7 | *Bacillus* Sp. | 76 | 324 | 251 | 88 | globlastp |
| MBI7_H113 | MBI7 | *Bacillus* Sp. | 77 | 325 | 251 | 85.5 | globlastp |
| MBI7_H116 | MBI7 | *Bacillus* Sp. | 78 | 326 | 251 | 84.5 | globlastp |
| MBI7_H117 | MBI7 | *Bacillus* Sp. | 79 | 327 | 251 | 83.2 | globlastp |
| MBI7_H119 | MBI7 | *Bacillus* Sp. | 80 | 328 | 251 | 82.7 | globlastp |
| MBI7_H120 | MBI7 | *Bacillus* Sp. | 81 | 329 | 251 | 80.2 | globlastp |
| MBI11_H35 | MBI11 | *Bacillus* Sp. | 82 | 330 | 252 | 99 | globlastp |
| MBI11_H65 | MBI11 | *Bacillus* Sp. | 83 | 331 | 252 | 98.1 | globlastp |
| MBI11_H83 | MBI11 | *Bacillus* Sp. | 84 | 332 | 252 | 97 | globlastp |
| MBI11_H84 | MBI11 | *Bacillus* Sp. | 85 | 333 | 252 | 96.9 | globlastp |
| MBI11_H122 | MBI11 | *Bacillus* Sp. | 86 | 334 | 252 | 95 | globlastp |
| MBI11_H209 | MBI11 | *Bacillus* Sp. | 87 | 335 | 252 | 94 | globlastp |
| MBI11_H220 | MBI11 | *Bacillus* Sp. | 88 | 336 | 252 | 93 | globlastp |
| MBI11_H3 | MBI11 | *Bacillus* Sp. | 89 | 337 | 252 | 92.2 | globlastp |
| MBI11_H221 | MBI11 | *Bacillus* Sp. | 90 | 338 | 252 | 91.6 | globlastp |
| MBI11_H224 | MBI11 | *Bacillus* Sp. | 91 | 339 | 252 | 90 | globlastp |
| MBI11_H4 | MBI11 | *Bacillus* Sp. | 92 | 340 | 252 | 85.1 | globlastp |
| MBI11_H5 | MBI11 | *Bacillus* Sp. | 93 | 341 | 252 | 84 | globlastp |
| MBI11_H225 | MBI11 | *Bacillus* Sp. | 94 | 342 | 252 | 81.9 | globlastp |
| MBI13_H9 | MBI13 | *Bacillus* Sp. | 95 | 343 | 253 | 99.1 | globlastp |
| MBI13_H51 | MBI13 | *Bacillus* Sp. | 96 | 344 | 253 | 98.3 | globlastp |
| MBI13_H1 | MBI13 | *Bacillus* Sp. | 97 | 345 | 253 | 91.9 | globlastp |
| MBI13_H10 | MBI13 | *Bacillus* Sp. | 98 | 346 | 253 | 87 | globlastp |
| MBI13_H15 | MBI13 | *Bacillus* Sp. | 99 | 347 | 253 | 86.1 | globlastp |
| MBI13_H52 | MBI13 | *Bacillus* Sp. | 100 | 348 | 253 | 85.2 | globlastp |
| MBI13_H23 | MBI13 | *Bacillus* Sp. | 101 | 349 | 253 | 84.3 | globlastp |
| MBI13_H53 | MBI13 | *Bacillus* Sp. | 102 | 350 | 253 | 83.7 | globlastp |
| MBI13_H28 | MBI13 | *Bacillus* Sp. | 103 | 351 | 253 | 82.1 | globlastp |
| MBI13_H33 | MBI13 | *Bacillus* Sp. | 104 | 352 | 253 | 81.2 | globlastp |
| MBI13_H50 | MBI13 | *Bacillus* Sp. | 105 | 353 | 253 | 80.1 | globlastp |
| MBI14_H24 | MBI14 | *Bacillus* Sp. | 106 | 354 | 254 | 99.3 | globlastp |
| MBI14_H25 | MBI14 | *Bacillus* Sp. | 107 | 355 | 254 | 98.5 | globlastp |
| MBI14_H26 | MBI14 | *Bacillus* Sp. | 108 | 356 | 254 | 97.7 | globlastp |
| MBI14_H27 | MBI14 | *Bacillus* Sp. | 109 | 357 | 254 | 95 | globlastp |
| MBI14_H8 | MBI14 | *Bacillus* Sp. | 110 | 358 | 254 | 94.3 | globlastp |
| MBI14_H28 | MBI14 | *Bacillus* Sp. | 111 | 359 | 254 | 91 | globlastp |
| MBI14_H9 | MBI14 | *Bacillus* Sp. | 112 | 360 | 254 | 90.4 | globlastp |
| MBI14_H10 | MBI14 | *Bacillus* Sp. | 113 | 361 | 254 | 89.4 | globlastp |
| MBI14_H13 | MBI14 | *Bacillus* Sp. | 114 | 362 | 254 | 87.3 | globlastp |
| MBI14_H17 | MBI14 | *Bacillus* Sp. | 115 | 363 | 254 | 85.5 | globlastp |
| POC19 | MBI14 | *Bacillus* Sp. | 116 | 364 | 254 | 84.1 | globlastp |
| MBI14_H20 | MBI14 | *Bacillus* Sp. | 117 | 365 | 254 | 83.7 | globlastp |
| MBI14_H23 | MBI14 | *Bacillus* Sp. | 118 | 366 | 254 | 81 | globlastp |
| MBI17_H11 | MBI17 | *Massilia* Sp. | 119 | 367 | 255 | 94.5 | globlastp |
| MBI17_H1 | MBI17 | *Janthinobacterium* Sp. | 120 | 368 | 255 | 93.3 | globlastp |
| MBI17_H2 | MBI17 | *Janthinobacterium* Sp. | 121 | 369 | 255 | 92.6 | globlastp |
| MBI17_H3 | MBI17 | *Janthinobacterium* Sp. | 122 | 370 | 255 | 90.2 | globlastp |
| MBI17_H6 | MBI17 | *Oxalobacteraceae* Sp. | 123 | 371 | 255 | 89 | globlastp |

TABLE 28-continued

Homologues (i.e., orthologues) of the identified insecticidal genes/polypeptides retaining insecticidal activity by themselves

| Gene Name | Hom. to: | Source (when public - accession number is provided) | P.N. SEQ ID NO: | P.P. SEQ ID NO: | Hom. to SEQ ID NO: | % glob. Iden. | Algor. |
|---|---|---|---|---|---|---|---|
| MBI17_H7 | MBI17 | *Collimonas* Sp. | 124 | 372 | 255 | 87.1 | globlastp |
| MBI17_H12 | MBI17 | *Collimonas* Sp. | 125 | 373 | 255 | 85.3 | globlastp |
| MBI17_H13 | MBI17 | *Collimonas* Sp. | 126 | 374 | 255 | 84.7 | globlastp |
| MBI17_H14 | MBI17 | *Variovorax* Sp. | 127 | 375 | 255 | 82.2 | globlastp |
| MBI17_H10 | MBI17 | *Janthinobacterium* Sp. | 128 | 376 | 255 | 80.4 | globlastp |
| MBI22_H41 | MBI22 | *Stenotrophomonas* Sp. | 129 | 377 | 257 | 99.3 | globlastp |
| MBI22_H25 | MBI22 | *Stenotrophomonas* Sp. | 130 | 378 | 257 | 97.4 | globlastp |
| MBI22_H52 | MBI22 | *Stenotrophomonas* Sp. | 131 | 379 | 257 | 95.1 | globlastp |
| MBI22_H27 | MBI22 | *Stenotrophomonas* Sp. | 132 | 380 | 257 | 93.2 | globlastp |
| MBI22_H38 | MBI22 | *Lysobacter* Sp. | 133 | 381 | 257 | 91.3 | globlastp |
| MBI22_H29 | MBI22 | *Stenotrophomonas* Sp. | 134 | 382 | 257 | 90.4 | globlastp |
| MBI22_H30 | MBI22 | *Stenotrophomonas* Sp. | 135 | 383 | 257 | 85 | globlastp |
| MBI22_H31 | MBI22 | *Stenotrophomonas* Sp. | 136 | 384 | 257 | 84 | globlastp |
| MBI22_H45 | MBI22 | *Stenotrophomonas* Sp. | 137 | 385 | 257 | 83.9 | globlastp |
| MBI22_H33 | MBI22 | environmental sample | 138 | 386 | 257 | 82 | globlastp |
| MBI22_H49 | MBI22 | *Stenotrophomonas* Sp. | 139 | 387 | 257 | 81.1 | globlastp |
| MBI23_H9 | MBI23 | *Streptomyces* Sp. | 140 | 388 | 258 | 91.5 | globlastp |
| MBI23_H10 | MBI23 | *Streptomyces* Sp. | 141 | 389 | 258 | 88.9 | globlastp |
| MBI23_H1 | MBI23 | *Streptomyces* Sp. | 142 | 390 | 258 | 82 | globlastp |
| MBI23_H11 | MBI23 | *Streptomyces* Sp. | 143 | 391 | 258 | 81.4 | globlastp |
| MBI23_H8 | MBI23 | *Streptomyces* Sp. | 144 | 392 | 258 | 80 | globlastp |
| MBI27_H119 | MBI27_H1 | *Streptomyces* Sp. | 145 | 393 | 286 | 87 | globlastp |
| MBI27_H121 | MBI27_H1 | *Streptomyces* Sp. | 146 | 394 | 286 | 91.2 | globlastp |
| MBI27_H122 | MBI27_H3 | *Streptomyces* Sp. | 147 | 395 | 288 | 85.1 | globlastp |
| MBI27_H123 | MBI27_H1 | *Streptomyces* Sp. | 148 | — | 286 | 83.6 | globlastp |
| MBI33_H3 | MBI33 | *Streptomyces* Sp. | 149 | 396 | 261 | 93.2 | globlastp |
| MBI33_H1 | MBI33 | *Streptomyces* Sp. | 150 | 397 | 261 | 92.2 | globlastp |
| MBI33_H2 | MBI33 | *Streptomyces* Sp. | 151 | 398 | 261 | 86.4 | globlastp |
| MBI34_H1 | MBI34 | *Saccharothrix* Sp. | 152 | 399 | 262 | 82 | globlastp |
| MBI35_H1 | MBI35 | *Kitasatospora* Sp. | 153 | 400 | 263 | 88.9 | globlastp |
| MBI36_H1 | MBI36 | *Streptomyces* Sp. | 154 | 401 | 264 | 84.3 | globlastp |
| MBI36_H2 | MBI36 | *Streptomyces* Sp. | 155 | 402 | 264 | 83.1 | globlastp |
| MBI36_H6 | MBI36 | *Streptomyces* Sp. | 156 | 403 | 264 | 82.2 | globlastp |
| MBI36_H4 | MBI36 | *Sitreptomyces* Sp. | 157 | 404 | 264 | 81.2 | globlastp |
| MBI36_H5 | MBI36 | *Streptomyces* Sp. | 158 | 405 | 264 | 80.2 | globlastp |
| MBI46_H1 | MBI46 | *Streptomyces* Sp. | 159 | 406 | 269 | 86.6 | globlastp |
| MBI48_H2 | MBI48 | *Streptomyces* Sp. | 160 | 407 | 270 | 96.7 | globlastp |
| MBI48_H3 | MBI48 | *Streptomyces* Sp. | 161 | 408 | 270 | 96.1 | globlastp |
| MBI48_H1 | MBI48 | *Streptomyces* Sp. | 162 | 409 | 270 | 95.4 | globlastp |
| MBI48_H4 | MBI48 | *Streptomyces* Sp. | 163 | 410 | 270 | 94.7 | globlastp |
| MBI51_H1 | MBI51 | *Streptomyces* Sp. | 164 | 411 | 272 | 87.5 | globlastp |
| MBI55_H15 | MBI55 | *Streptomyces* Sp. | 165 | 412 | 273 | 94 | globlastp |
| MBI55_H16 | MBI55 | *Streptomyces* Sp. | 166 | 413 | 273 | 93 | globlastp |
| MBI55_H17 | MBI55 | *Streptomyces* Sp. | 167 | 414 | 273 | 92.9 | globlastp |
| MBI55_H6 | MBI55 | *Streptomyces* Sp. | 168 | 415 | 273 | 91.1 | globlastp |
| MBI55_H10 | MBI55 | *Streptomyces* Sp. | 169 | 416 | 273 | 90 | globlastp |
| MBI55_H18 | MBI55 | *Streptomyces* Sp. | 170 | 417 | 273 | 88.8 | globlastp |
| MBI55_H11 | MBI55 | *Streptomyces* Sp. | 171 | 418 | 273 | 86.9 | globlastp |
| MBI55_H13 | MBI55 | *Streptomyces* Sp. | 172 | 419 | 273 | 85.4 | globlastp |
| MBI55_H14 | MBI55 | *Streptomyces* Sp. | 173 | 420 | 273 | 83.3 | globlastp |
| MBI61_H72 | MBI61 | *Bacillus* Sp. | 174 | 421 | 274 | 97 | globlastp |
| MBI61_H21 | MBI61 | *Bacillus* Sp. | 175 | 422 | 274 | 96.5 | globlastp |
| MBI61_H73 | MBI61 | *Bacillus* Sp. | 176 | 423 | 274 | 95.8 | globlastp |
| MBI61_H1 | MBI61 | *Bacillus* Sp. | 177 | 424 | 274 | 94.4 | globlastp |
| MBI61_H23 | MBI61 | *Bacillus* Sp. | 178 | 425 | 274 | 93.3 | globlastp |
| MBI61_H26 | MBI61 | *Salinibacillus* Sp. | 179 | 426 | 274 | 90.2 | globlastp |
| MBI61_H35 | MBI61 | *Bacillus* Sp. | 180 | 427 | 274 | 89.3 | globlastp |
| MBI61_H74 | MBI61 | *Bacillus* Sp. | 181 | 428 | 274 | 87 | globlastp |
| MBI61_H75 | MBI61 | *Bacillus* Sp. | 182 | 429 | 274 | 86.8 | globlastp |
| MBI61_H3 | MBI61 | *Bacillus* Sp. | 183 | 430 | 274 | 85.9 | globlastp |
| MBI61_H76 | MBI61 | *Bacillus* Sp. | 184 | 431 | 274 | 82 | globlastp |
| MBI61_H77 | MBI61 | *Streptococcus* Sp. | 185 | 432 | 274 | 81.6 | globlastp |
| MBI61_H4 | MBI61 | *Bacillus* Sp. | 186 | 433 | 274 | 80.1 | globlastp |
| MBI63_H1 | MBI63 | *Kitasatospora* Sp. | 187 | 434 | 275 | 92.9 | globlastp |
| MBI68_H1 | MBI68 | *Stenotrophomonas* Sp. | 188 | 435 | 276 | 99.3 | globlastp |
| MBI68_H2 | MBI68 | *Stenotrophomonas* Sp. | 189 | 436 | 276 | 94.5 | globlastp |
| MBI68_H3 | MBI68 | *Stenotrophomonas* Sp. | 190 | 437 | 276 | 93.7 | globlastp |
| MBI68_H4 | MBI68 | *Stenotrophomonas* Sp. | 191 | 438 | 276 | 84 | globlastp |
| MBI68_H5 | MBI68 | *Pseudomonas* Sp. | 192 | 439 | 276 | 83.8 | globlastp |
| MBI72_H2 | MBI72 | *Streptomyces* Sp. | 193 | 440 | 278 | 85.9 | globlastp |
| MBI72_H1 | MBI72 | *Streptomyces* Sp. | 194 | 441 | 278 | 85.5 | globlastp |
| MBI73_H4 | MBI73 | *Streptomyces* Sp. | 195 | 442 | 279 | 91.5 | globlastp |
| MBI73_H1 | MBI73 | *Streptomyces* Sp. | 196 | 443 | 279 | 88.3 | globlastp |

TABLE 28-continued

Homologues (i.e., orthologues) of the identified insecticidal genes/polypeptides retaining insecticidal activity by themselves

| Gene Name | Hom. to: | Source (when public - accession number is provided) | P.N. SEQ ID NO: | P.P. SEQ ID NO: | Hom. to SEQ ID NO: | % glob. Iden. | Algor. |
|---|---|---|---|---|---|---|---|
| MBI73_H2 | MBI73 | *Streptomyces* Sp. | 197 | 444 | 279 | 87.2 | globlastp |
| MBI73_H5 | MBI73 | *Streptomyces* Sp. | 198 | 445 | 279 | 84.7 | globlastp |
| MBI73_H6 | MBI73 | *Kitasatospora* Sp. | 199 | 446 | 279 | 82 | globlastp |
| MBI76_H1 | MBI76 | *Streptomyces* Sp. | 200 | 447 | 281 | 95.7 | globlastp |
| MBI79_H58 | MBI79 | *Streptococcus* Sp. | 201 | 448 | 282 | 99.5 | globlastp |
| MBI79_H29 | MBI79 | *Bacillus* Sp. | 202 | 449 | 282 | 97.6 | globlastp |
| MBI79_H59 | MBI79 | *Bacillus* Sp. | 203 | 450 | 282 | 96.1 | globlastp |
| MBI79_H33 | MBI79 | *Bacillus* Sp. | 204 | 451 | 282 | 95.1 | globlastp |
| MBI79_H60 | MBI79 | *Bacillus* Sp. | 205 | 452 | 282 | 86.9 | globlastp |
| MBI79_H34 | MBI79 | *Bacillus* Sp. | 206 | 453 | 282 | 85 | globlastp |
| MBI79_H61 | MBI79 | *Bacillus* Sp. | 207 | 454 | 282 | 84 | globlastp |
| MBI79_H56 | MBI79 | *Bacillus* Sp. | 208 | 455 | 282 | 83 | globlastp |
| MBI79_H57 | MBI79 | *Salinibacillus* Sp. | 209 | 456 | 282 | 82 | globlastp |
| MBI22_H35 | MBI22_H2 | *Pseudomonas* Sp. | 210 | 457 | 284 | 99 | globlastp |
| MBI22_H36 | MBI22_H2 | *Stenotrophomonas* Sp. | 211 | 458 | 284 | 98.8 | globlastp |
| MBI22_H37 | MBI22_H2 | *Stenotrophomonas* Sp. | 212 | 459 | 284 | 97.8 | globlastp |
| MBI22_H40 | MBI22_H2 | *Stenotrophomonas* Sp. | 213 | 460 | 284 | 91.2 | globlastp |
| MBI22_H42 | MBI22_H2 | *Stenotrophomonas* Sp. | 214 | 461 | 284 | 88 | globlastp |
| MBI22_H43 | MBI22_H2 | *Stenotrophomonas* Sp. | 215 | 462 | 284 | 87.8 | globlastp |
| MBI22_H44 | MBI22_H2 | *Stenotrophomonas* Sp. | 216 | 463 | 284 | 86.1 | globlastp |
| MBI22_H18 | MBI22_H2 | *Stenotrophomonas* Sp. | 217 | 464 | 284 | 85.2 | globlastp |
| MBI22_H23 | MBI22_H2 | *Stenotrophomonas* Sp. | 218 | 465 | 284 | 81.1 | globlastp |
| MBI22_H54 | MBI22_H2 | *Stenotrophomonas* Sp. | 219 | 466 | 284 | 80.9 | globlastp |
| MBI22_H48 | MBI22_H3 | *Stenotrophomonas* Sp. | 220 | 467 | 285 | 96 | globlastp |
| MBI22_H50 | MBI22_H3 | *Stenotrophomonas* Sp. | 221 | 468 | 285 | 93.3 | globlastp |
| MBI22_H51 | MBI22_H3 | *Stenotrophomonas* Sp. | 222 | 469 | 285 | 90.7 | globlastp |
| MBI22_H53 | MBI22_H3 | *Stenotrophomonas* Sp. | 223 | 470 | 285 | 84.1 | globlastp |
| MBI22_H5 | MBI22_H3 | *Stenotrophomonas* Sp. | 224 | 471 | 285 | 80.1 | globlastp |
| MBI27_H106 | MBI27_H3 | *Streptomyces* Sp. | 225 | 472 | 288 | 93.6 | globlastp |
| MBI27_H113 | MBI27_H3 | *Streptomyces* Sp. | 226 | 473 | 288 | 88.2 | globlastp |
| MBI27_H101 | MBI27_H4 | *Streptomyces* Sp. | 227 | 474 | 289 | 87 | globlastp |
| MBI27_H47 | MBI27_H6 | *Streptomyces* Sp. | 228 | 475 | 291 | 99.7 | globlastp |
| MBI27_H48 | MBI27_H6 | *Streptomyces* Sp. | 229 | 476 | 291 | 98.2 | globlastp |
| MBI27_H46 | MBI27_H6 | *Streptomyces* Sp. | 230 | 477 | 291 | 97.2 | globlastp |
| MBI27_H38 | MBI27_H6 | *Streptomyces* Sp. | 231 | 478 | 291 | 89.7 | globlastp |
| MBI27_H39 | MBI27_H6 | *Streptomyces* Sp. | 232 | 479 | 291 | 85.9 | globlastp |
| MBI27_H43 | MBI27_H6 | *Streptomyces* Sp. | 233 | 480 | 291 | 84.3 | globlastp |
| MBI27_H100 | MBI27_H7 | *Streptomyces* Sp. | 234 | 481 | 292 | 82.8 | globlastp |
| MBI27_H93 | MBI27_H8 | *Streptomyces* Sp. | 235 | 482 | 293 | 95.6 | globlastp |
| MBI27_H94 | MBI27_H8 | *Streptomyces* Sp. | 236 | 483 | 293 | 87.4 | globlastp |
| MBI27_H22 | MBI27_H8 | *Streptomyces* Sp. | 237 | 484 | 293 | 86.4 | globlastp |
| MBI27_H95 | MBI27_H8 | *Streptomyces* Sp. | 238 | 485 | 293 | 85.6 | globlastp |
| MBI4_H71 | MBI4_H4 | *Bacillus* Sp. | 239 | 486 | 296 | 93.8 | globlastp |
| MBI4_H65 | MBI4_H4 | *Bacillus* Sp. | 240 | 487 | 296 | 92 | globlastp |
| MBI4_H73 | MBI4_H4 | *Bacillus* Sp. | 241 | 488 | 296 | 88.1 | globlastp |
| MBI4_H74 | MBI4_H4 | *Bacillus* Sp. | 242 | 489 | 296 | 87.1 | globlastp |
| MBI4_H64 | MBI4_H4 | *Bacillus* Sp. | 243 | 490 | 296 | 86 | globlastp |
| POCM25_H1 | POCM25 | *Streptomyces* Sp. | 244 | 491 | 298 | 96.4 | globlastp |
| POCM25_H2 | POCM25 | *Streptomyces* Sp. | 245 | 492 | 298 | 86.9 | globlastp |
| POCM25_H3 | POCM25 | *Streptomyces* Sp. | 246 | 493 | 298 | 82.8 | globlastp |
| POCM25_H5 | POCM25 | *Streptomyces* Sp. | 247 | 494 | 298 | 81.1 | globlastp |
| POCM25_H8 | POCM25 | *Streptomyces* Sp. | 248 | 495 | 298 | 80.3 | globlastp |

Table 28: Provided are the homologous (i.e., orthologous) polypeptides and polynucleotides of the insecticidal progenitors. Homology was calculated as % of identity over the aligned sequences. The query sequences were the curated polypeptide sequences depicted in Table 22 (Example 4). The subject sequences are protein sequences identified in the database based on greater than 80% global identity to the predicted translated sequences of the query nucleotide sequences or to the polypeptide sequences.
"P.N." = polynucleotide; "P.P." = polypeptide; "Algor." = algorithm (used for sequence alignment and determination of percent homology); "Hom."—homology; "iden."—identity; "glob."—global. Shown are the global sequence identities between the homologous polypeptides and the "core" polypeptides.

The output of the functional genomics approach described herein is a set of genes highly predicted to improve insect control traits.

Example 6

Identification of Domains Comprised in Identified Polypeptides Encoded by the Identified Genes A polypeptide domain refers to a set of conserved amino acids located at specific positions along an alignment of sequences of evolutionarily related proteins. While amino acids at other positions can vary between homologues, amino acids that are highly conserved, and particularly amino acids that are highly conserved at specific positions indicate amino acids that are likely essential in the structure, stability and/or function of a protein. Identified by their high degree of conservation in aligned sequences of a family of protein homologues, the amino acids, and as a consequence, domains can be used as identifiers to determine if any polypeptide in question belongs to a previously identified polypeptide family.

The Integrated Resource of Protein Families, Domains and Sites (INTERPRO™; Interpro Technology, Inc. in Rochester, Mich., USA) database is an integrated interface for the commonly used signature databases for text- and sequence-based searches. The INTERPRO™ database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGR-FAMs. Pfam is a large collection of multiple sequence alignments and hidden Markov models covering many common protein domains and families. Pfam is hosted at the Sanger Institute server in the United Kingdom.

INTERPRO™ is hosted at the European Bioinformatics Institute in the United Kingdom. InterProScan is the software package that allows sequences (protein and nucleic acid sequences) to be scanned against InterPro's signatures. Signatures are predictive models, provided by several different databases, that make up the InterPro consortium.

InterProScan 5.11-51.0 was used to analyze the polypeptides of some embodiments of the invention (core polypeptides as well as homologues and/or orthologues thereof) for common domains [Mitchell A et al., 2015. Nucleic Acids Research 43: D213-221]. Briefly, InterProScan is based on scanning methods native to the INTERPRO™ member databases. It is distributed with pre-configured method cut-offs recommended by the member database experts and which are believed to report relevant matches. All cut-offs are defined in configuration files of the InterProScan programs. Matches obtained with the fixed cut-off are subject to the following filtering:

Pfam Filtering:

Each Pfam family is represented by two hidden Markov models (HMMs) -ls and fs (full-length and fragment). An HMM model has bit score cut-offs (for each domain match and the total model match) and these are defined in the Gathering threshold (GA) lines of the Pfam database. Initial results are obtained with quite a high common cut-off and then the matches of the signature with a lower score than the family specific cut-offs are dropped.

If both the fs and ls model hit for a particular Pfam hits the same region of a sequence, the Alignment Method (AM) field in the Pfam database is used to determine which model should be chosen—globalfirst (LS); localfirst (FS) or byscore (whichever has the highest e-value).

Another type of filtering has been implemented since release 4.1. It is based on Clan filtering and nested domains. Further information on Clan filtering can be found in the Pfam website [worldwideweb(dot)sanger(dot)ac(dot)uk/Pfam] for more information on Clan filtering.

TIGRFAMs Filtering:

Each TIGRFAM HMM model has its own cut-off scores for each domain match and the total model match. These bit score cut-offs are defined in the "trusted cut-offs" (TC) lines of the database. Initial results are obtained with quite a high common cut-off and then the matches (of the signature or some of its domains) with a lower score compared to the family specific cut-offs are dropped.

PRINTS Filtering:

All matches with p-value more than a pre-set minimum value for the signature are dropped.

SMART Filtering:

The publicly distributed version of InterProScan has a common e-value cut-off corresponding to the reference database size. A more sophisticated scoring model is used on the SMART web server and in the production of pre-calculated InterPro match data.

Exact scoring thresholds for domain assignments are proprietary data. The InterProMatches data production procedure uses these additional smart thresholds data. It is to be noted that the given cut-offs are e-values (i.e., the number of expected random hits) and therefore are only valid in the context of reference database size and of data files for filtering out results obtained with higher cut-off.

It implements the following logic: If the whole sequence E-value of a found match is worse than the 'cut_low', the match is dropped. If the domain E-value of a found match is worse than the 'repeat' cut-off (where defined) the match is dropped. If a signature is a repeat, the number of significant matches of that signature to a sequence must be greater than the value of 'repeats' in order for all matches to be accepted as true (T).

If the signature is part of a family ('family_cut' is defined) and if the domain E-value is worse than the domain cut off ('cutoff') then the match is dropped. If the signature has "siblings" (because it has a family_cut defined), and they overlap, the preferred sibling is chosen as the true match according to information in the overlaps file.

PROSITE Patterns CONFIRMation:

ScanRegExp is able to verify PROSITE matches using corresponding statistically-significant CONFIRM patterns. The default status of the PROSITE matches is unknown (?) and the true positive (T) status is assigned if the corresponding CONFIRM patterns match as well. The CONFIRM patterns were generated based on the true positive SWISS-PROT PROSITE matches using eMOTIF software with a stringency of $10e^{-9}$ P-value.

PANTHER Filtering:

Panther has pre- and post-processing steps. The pre-processing step is intended to speed up the HMM-based searching of the sequence and involves blasting the HMM sequences with the query protein sequence in order to find the most similar models above a given e-value. The resulting HMM hits are then used in the HMM-based search.

Panther consists of families and sub-families. When a sequence is found to match a family in the blast run, the sub-families are also scored using HMMER tool (that is, unless there is only 1 sub-family, in which case, the family alone is scored against).

Any matches that score below the e-value cut-off are discarded. Any remaining matches are searched to find the HMM with the best score and e-value and the best hit is then reported (including any sub-family hit).

GENE3D Filtering:

Gene3D also employs post-processing of results by using a program called DomainFinder. This program takes the output from searching the Gene3D HMMs against the query sequence and extracts all hits that are more than 10 residues long and have an e-value better than 0.001. If hits overlap at all, the match with the better e-value is chosen.

The polypeptides of some embodiments of the invention, which when expressed in a plant (e.g., over-expressed) can result in insect resistance by evoking insecticidal effects, can be characterized by specific amino acid domains. According to some embodiments of the invention, particular domains are conserved within a family of polypeptides as described in Table 29 hereinbelow. Without wishing to be bound by specific theory or mechanism of action, the conserved domain may indicate common function of the polypeptides comprising same. The domains are presented by an arbitrary identifier (*ID). Table 30 provides the details of each domain according to the InterPro Entry.

Table 29 summarizes the domains in each of the "core" polypeptides (i.e., the polypeptides from Table 22) identified by the present inventors as being capable the desired traits (e.g., as listed above) when over-expressed in a plant, wherein each of the listed domains is conserved in the representative homologous polypeptides identified by the present inventors (as detailed in Table 28 in Example 5 above) exhibiting at least 80% global identity to the "core" polypeptides. As explained above, each domain received an arbitrary ID number (from 1-76), wherein description of these arbitrary domain IDs according to the InterPro database is provided in Table 30 below. In addition, the start and end positions of each of the domains is indicated with respect to the amino acid sequence of the "core" polypeptide. Table 29 also provides the E-values for each of the conserved domains as indicated by the domain tool used for analyzing these sequences, as part of INTERPROSCAN programs, e.g., SMART, PROSITE scans patterns and profiles. For example, in the case of the PROSITE search, the PROSITE profiles report normalized scores instead of E-values, which are defined as the base 10 logarithm of the size (in residues) of the database in which one false positive match is expected to occur by chance. The normalized score is independent of the size of the databases searched. The so-called bit scores reported by other database-search programs have a distinct meaning but are also independent of the size of the database searched.

For example, for SEQ ID NO: 250, the domain ID "1" appears at amino acid positions 291 through 374 (marked as "291_374"). In addition, the annotation appears with normalized score of 6.00E-05. It is further noted that for some domains the e-value is not specified and instead there is a mark of "-;". In these cases (-;) the presence of the domain was verified by ScanRegExp, which is able to verify PROSITE matches using corresponding statistically-significant CONFIRM patterns. The CONFIRM patterns were generated based on the true positive SWISS-PROT PROSITE matches using eMOTIF software with a stringency of 10e-9 P-value. Further details can be found in hypertext transfer protocol://computing(dot)bio(dot)cam(dot)ac(dot)uk/local/doc/iprscan(dot)html.

TABLE 29

Identified Domains in Insecticidal Genes

| P.P. (SEQ ID NO) | Common Domains by InterPro Entry (*ID) | Amino acid Positions of Start-End of the Domain Match | E-value of the Domain Match** |
|---|---|---|---|
| 250 | 1 | 291_374 | 6.00E-05 |
| 251 | 2; 3 | 57_135; 58_180 | 1.2E-7; 2.62E-26 |
| 252 | 4; 7; 7; 7; 7; 7; 7; 8; 8; 8; 5; 8 | 97_278; 163_181; 302_629; 449_463; 466_482; 503_521; 529_544; 771_856; 772_858; 773_855; 775_857; 786_847 | 2.3E-58; 1.2E-32; 2.2E-82; 1.2E-32; 1.2E-32; 1.2E-32; 1.2E-32; 1.11E-23; 4.9E-23; 20.944; 4.5E-25; 2.4E-13 |
| 255 | 9; 9; 9; 9 | 1_143; 1_162; 2_161; 6_138 | 6.5E-26; 6.2E-58; 9.15E-51; 1.3E-41 |
| 256 | 11; 11; 11; 10 | 166_193; 167_193; 774_801; 775_818 | 0.0013; 5.0E-7; 5.5E-6; 9.6E-7 |
| 257 | 13; 12; 13; 13; 13; 13 | 640_956; 665_956; 670_956; 672_956; 674_940; 676_946 | 2.75E-40; 1.4E-25; 2.5E-40; 33.337; 3.6E-33; 2.1E-28 |

TABLE 29-continued

Identified Domains in Insecticidal Genes

| P.P. (SEQ ID NO) | Common Domains by InterPro Entry (*ID) | Amino acid Positions of Start-End of the Domain Match | E-value of the Domain Match** |
|---|---|---|---|
| 258 | 14; 14; 14; 16; 16; 16; 17; 15; 15; 17; 18 | 45_186; 46_183; 92_219; 239_307; 373_437; 511_533; 674_807; 678_808; 678_807; 679_808; 814_1001 | 1.6E-32; 1.1E-24; 5.1E-26; 3.7E-8; 3.7E-8; 3.7E-8; 4.73E-22; 2.2E-15; 15.995; 1.8E-25; 5.1E-33 |
| 259 | 14; 14; 14; 20; 20; 19; 20; 19; 19; 20; 19 | 35_170; 40_154; 42_147; 170_254; 172_253; 174_258; 270_452; 272_348; 468_561; 469_553; 614_669 | 0.0025; 7.8E-17; 1.1E-7; 2.51E-5; 34.0; 1.2E-10; 53.0; 5.8E-8; 8.6E-4; 4.0; 9.8E-6 |
| 260 | 17 | 29_97 | 1.20E-04 |
| 261 | 19; 22; 23 | 397_478; 397_478; 431_470 | 8.4E-12; 2.35E-12; 3.6E-11 |
| 262 | 24; 24; 24; 22; 19; 24; 24; 24; 24 | 450_593; 451_582; 486_576; 610_691; 611_693; 698_829; 704_828; 705_829; 731_815 | 3.6; 5.51E-15; 3.3E-9; 2.35E-8; 7.3E-6; 2.9E-17; 6.23E-33; 17.991; 7.0E-22 |
| 263 | 24; 24; 15; 17; 17; 26; 25 | 38_165; 39_164; 205_337; 229_332; 231_336; 400_769; 557_611 | 10.264; 2.11E-13; 9.284; 2.41E-7; 3.3E-8; 2.54E-18; 5.0E-5 |
| 265 | 29; 27; 29; 28; 28; 27; 29; 28; 27; 28; 28; 28; 24; 24; 24 | 56_155; 58_314; 219_317; 232_254; 294_316; 392_471; 392_585; 404_425; 455_573; 456_489; 497_519; 558_600; 607_739; 608_739; 609_675 | 1.0E-10; 7.54E-16; 1.0E-10; 9000.0; 540.0; 7.54E-16; 1.0E-10; 85.0; 5.45E-9; 1100.0; 130.0; 1500.0; 13.452; 1.37E-27; 1.4E-11 |
| 266 | 30; 31; 30; 31; 30 | 212_251; 213_247; 231_272; 231_267; 252_281 | 2.0E-5; 5.5E-5; 5.7E-12; 3.2E-9; 2.6E-5 |
| 267 | 30; 31; 35; 32; 19; 35; 19; 32; 35; 35; 34; 33 | 105_136; 105_135; 142_223; 144_222; 145_219; 145_221; 225_303; 225_306; 226_308; 227_296; 1132_1186; 1139_1196 | 3.1E-9; 7.2E-8; 1.8; 3.06E-13; 3.4E-13; 3.0E-8; 3.5E-14; 6.3E-13; 0.066; 8.4E-7; 2.75E-5; 1.8E-4 |
| 268 | 38; 36; 37 | 61_417; 63_98; 74_154 | 9.1E-34; 4.1E-8; 9.653 |
| 269 | 39; 39; 39; 41; 41; 40; 40; 40 | 1_90; 2_141; 176_236; 632_841; 633_839; 653_675; 707_724; 759_781 | 2.8E-6; 1.39E-11; 1.39E-11; 1.44E-20; 1.7E-23; 5.1E-6; 5.1E-6; 5.1E-6 |
| 270 | 24; 24; 24; 24 | 320_452; 322_450; 324_452; 331_449 | 24.748; 2.23E-28; 3.8E-22; 4.8E-21 |
| 271 | 30; 31; 30; 30; 31; 24; 24; 24; 24; 43; 45; 42; 42; 44 | 1144_1178; 1360_1397; 1362_1400; 1403_1433; 1403_1432; 1769_1898; 1773_1898; 1779_1896; 1780_1895; 2021_2101; 2324_2427; 2327_2473; 2328_2429; 2494_2596 | 1.5E-4; 3.5E-5; 5.7E-5; 1.1E-4; 5.2E-5; 30.562; 1.7E-23; 4.46E-35; 2.9E-25; 3.4E-15; 0.0065; 5.1E-17; 5.49E-14; 3.5E-8 |
| 272 | 24; 24; 24; 24; 46; 46; 47 | 1004_1135; 1008_1133; 1009_1135; 1017_1132; 1210_1433; 1217_1433; 1287_1428 | 27.069; 1.76E-31; 4.7E-18; 1.0E-21; 1.1E-32; 2.49E-33; 3.3E-12 |
| 273 | 48; 49 | 47_525; 528_687 | 6.5E-178; 3.4E-53 |
| 274 | 27; 29; 51; 28; 28; 28; 28; 27; 28; 28; 50 | 78_372; 80_403; 82_303; 199_221; 237_259; 260_292; 294_315; 376_517; 419_441; 448_470; 593_806 | 5.03E-33; 2.5E-29; 2.7E-21; 120.0; 40.0; 1700.0; 4100.0; 6.06E-5; 20.0; 790.0; 2.5E-81 |

TABLE 29-continued

Identified Domains in Insecticidal Genes

| P.P. (SEQ ID NO) | Common Domains by InterPro Entry (*ID) | Amino acid Positions of Start-End of the Domain Match | E-value of the Domain Match** |
|---|---|---|---|
| 276 | 31 | 652_685 | 2.40E-05 |
| 277 | 30; 31; 30; 31; 43; 42; 42; 53; 53 | 1293_1331; 1293_1330; 1335_1367; 1335_1364; 2087_2166; 2321_2474; 2323_2472; 2446_2472; 2447_2472 | 6.6E-8; 1.8E-8; 5.9E-6; 5.5E-5; 2.3E-17; 3.4E-21; 6.28E-17; 8.415; 0.0023 |
| 278 | 54; 20; 19; 24; 24; 24; 24 | 248_403; 518_597; 519_587; 601_712; 601_693; 606_724; 640_713 | 1.5E-4; 2.21E-7; 3.2E-8; 6.03E-22; 14.931; 2.1E-7; 2.2E-12 |
| 279 | 56; 59; 57; 58; 55 | 14_297; 25_260; 34_299; 35_135; 186_285 | 1.6E-78; 7.5E-61; 1.08E-67; 2.6E-30; 9.2E-15 |
| 280 | 60; 30; 31; 30; 31; 43 | 298_554; 1328_1366; 1328_1363; 1370_1402; 1370_1399; 2123_2202 | 3.5E-5; 8.4E-6; 6.9E-8; 1.8E-6; 3.7E-5; 5.5E-17 |
| 282 | 32; 61 | 28_204; 28_202 | 7.14E-53; 3.8E-38 |
| 283 | 65; 65; 69; 69; 69; 69; 69; 24; 24; 24; 24; 24; 24; 24; 24; 70; 66; 63; 67; 62; 64; 64; 64; 66; 70; 68; 24; 24 | 61_303; 64_320; 360_375; 362_380; 408_693; 412_694; 435_687; 726_926; 728_795; 844_925; 883_1015; 885_1015; 887_1012; 963_1019; 1019_1145; 1020_1145; 1023_1142; 1025_1144; 1208_1513; 1209_1512; 1211_1666; 1212_1666; 1349_1357; 1512_1636; 1514_1572; 1613_1637; 1638_1668; 1643_1666; 1674_1847; 1855_1967; 1874_1969 | 3.5E-28; 1.15E-6; 6.1E-47; 7.99E-34; 6.1E-47; 7.99E-34; 1.1E-11; 11.106; 2.42E-7; 2.42E-7; 0.11; 1.16E-17; 8.9E-7; 11.794; 28.573; 4.1E-28; 4.1E-26; 4.22E-12; 2.1E-83; 4.52E-72; 5.7E-105; 2.4E-75; -; 3.07E-7; 1.7E-12; 1.7E-12; 4.52E-72; 2.1E-83; 3.3E-56; 9.754; 1.13E-8 |
| 284 | 13; 13; 12; 13; 13; 13 | 637_956; 669_956; 670_956; 672_956; 676_940; 676_946 | 3.01E-39; 1.1E-37; 1.4E-24; 32.713; 2.0E-30; 1.1E-28 |
| 285 | 13; 12; 13; 13; 13; 13 | 637_957; 657_957; 670_957; 673_957; 676_941; 677_947 | 4.32E-40; 2.5E-26; 1.0E-39; 33.181; 4.4E-33; 2.3E-29 |
| 286 | 14; 14; 14; 20; 20; 19; 20; 20; 19; 19; 20; 20; 19; 20; 20; 20; 19 | 34_171; 38_163; 39_147; 171_252; 171_343; 173_260; 173_270; 269_451; 271_346; 358_461; 358_465; 375_554; 467_558; 467_570; 468_551; 553_669; 613_670 | 9.1E-7; 1.7E-19; 7.6E-10; 10.0; 2.25E-8; 2.3E-11; 10.422; 7.9; 3.5E-8; 3.9E-4; 7.448; 2.56E-6; 1.1E-6; 9.208; 0.063; 110.0; 1.2E-7 |
| 287 | 14; 14; 14; 20; 20; 19; 20; 20; 19; 20; 20; 19; 20; 20; 20; 19 | 34_171; 39_146; 39_160; 16_278; 171_252; 173_262; 173_270; 269_451; 271_345; 358_465; 459_559; 467_560; 467_570; 468_551; 553_670; 613_667 | 2.4E-5; 4.8E-10; 2.4E-19; 8.39E-5; 30.0; 1.7E-9; 8.198; 55.0; 9.7E-7; 6.281; 3.05E-5; 4.8E-6; 10.146; 2.6; 160.0; 2.1E-5 |
| 288 | 14; 14; 14; 20; 20; 19; 20; 20; 19; 20; 19; 20; 20; 19 | 34_171; 39_162; 40_146; 170_255; 171_252; 173_262; 173_270; 269_451; 271_349; 358_465; 467_560; 467_570; 468_553; 613_669 | 3.4E-5; 4.5E-19; 3.3E-9; 7.29E-5; 34.0; 6.1E-10; 8.142; 33.0; 5.5E-7; 6.344; 2.2E-5; 9.76; 2.9; 7.1E-5 |
| 289 | 14; 14; 14; 20; 19; 20; 19; 19; 20; 19; 20; 19 | 34_169; 38_160; 39_147; 171_252; 173_260; 269_452; 271_347; 373_462; 377_555; 468_560; 469_554; 613_670 | 9.7E-6; 2.2E-18; 3.4E-10; 37.0; 3.7E-12; 21.0; 7.5E-7; 2.6E-4; 7.68E-7; 3.1E-6; 0.092; 2.4E-4 |
| 290 | 14; 14; 14; 20; 20; 19; 20; 20; 20; 19; 20; 20; 20; 20; 19 | 33_170; 36_146; 38_161; 169_255; 170_251; 172_261; 172_269; 261_343; 268_450; 270_345; 357_464; 392_552; 466_569; 467_550; 552_669; 612_667 | 2.5E-4; 2.1E-9; 7.6E-19; 1.22E-7; 15.0; 4.1E-12; 9.925; 7.81E-5; 51.0; 4.5E-7; 6.241; 1.91E-5; 8.292; 0.27; 200.0; 1.2E-7 |
| 291 | 14; 14; 14; 20; 20; 19; 20; 19; 19; 20; 20; 20; 19; 20; 20; 19 | 34_171; 38_165; 40_147; 168_264; 171_252; 173_263; 173_266; 271_347; 359_463; 359_467; 360_453; 370_555; 469_561; 469_572; 470_555; 611_665 | 2.0E-6; 3.6E-19; 4.8E-9; 3.28E-7; 14.0; 1.3E-12; 10.525; 2.9E-6; 3.5E-4; 9.46; 59.0; 8.37E-6; 3.0E-4; 8.45; 0.19; 7.5E-5 |
| 292 | 14; 14; 14; 20; 20; 19; 20; 20; 19; 19; 20; 20; 19; 20; 20; 19 | 34_171; 39_146; 39_164; 169_259; 171_252; 173_262; 173_270; 269_443; 271_336; 346_451; 347_456; 458_552; 458_558; 459_657; 599_654 | 1.2E-4; 6.4E-9; 2.2E-19; 6.43E-7; 3.7; 1.3E-11; 9.673; 29.0; 5.1E-7; 1.3E-4; 8.758; 9.0E-4; 8.505; 4.8; 1.8E-5 |
| 293 | 14; 14; 14; 20; 20; 19; 20; 20; 20; 19; 20; 20; 19; 20; 20; 20; 19; 20; 20; 19 | 38_174; 41_150; 43_165; 176_258; 178_275; 186_266; 261_376; 274_351; 276_365; 277_358; 352_467; 366_464; 370_455; 458_543; 463_538; 465_552; 466_540; 559_739; 559_653; 560_640; 562_644; 656_741; 657_755; 669_744 | 2.8E-5; 1.7E-11; 6.3E-17; 72.0; 8.718; 1.9E-8; 3.24E-10; 0.59; 11.361; 2.2E-12; 4.92E-5; 8.971; 3.1E-10; 1.19E-7; 9.8; 6.62; 8.1E-9; 1.78E-8; 10.722; 16.0; 2.7E-11; 21.0; 6.494; 1.3E-11 |
| 294 | 14; 14; 14; 19; 20; 20; 20; 20; 20; 19; 20; 20; 19; 20; 20; 19; 20; 20; 20; 19 | 35_173; 38_149; 40_172; 173_260; 173_250; 175_264; 260_352; 266_355; 267_342; 269_352; 354_448; 357_465; 366_454; 369_547; 464_544; 468_547; 570_660; 575_655; 577_668; 578_658 | 6.3E-5; 2.4E-11; 4.5E-18; 1.2E-9; 8.2; 10.43; 3.39E-6; 8.466; 11.0; 6.6E-11; 24.0; 10.02; 2.8E-6; 8.26E-8; 13.0; 1.9E-8; 3.81E-12; 0.0074; 11.835; 4.8E-15 |
| 295 | 14; 14; 14; 20; 20; 19; 20; 19; 20; 19; 20; 20; 20; 19; 20; 20; 19 | 37_173; 41_156; 41_164; 173_255; 175_271; 185_265; 269_449; 271_345; 355_464; 371_458; 371_561; 466_564; 467_658; 471_561; 576_664; 579_669; 589_660 | 3.4E-10; 4.6E-15; 5.5E-22; 0.083; 11.511; 1.2E-13; 6.6; 1.6E-7; 8.166; 4.2E-8; 6.41E-8; 7.267; 32.0; 9.6E-9; 8.69E-6; 11.132; 1.9E-12 |
| 296 | 1; 1 | 203_227; 287_355 | 3.1E-5; 3.1E-5 |
| 297 | 71; 71; 54 | 58_114; 118_167; 204_350 | 6.0E-15; 1.3E-19; 8.4E-11 |
| 298 | 16; 75; 73; 75; 8; 8; 5; 8; 8; 72; 17; 17; 15; 15; 74; 74; 76; 18 | 22_494; 42_326; 57_329; 392_468; 492_576; 493_574; 494_577; 495_576; 499_566; 681_814; 684_813; 685_813; 686_813; 689_813; 819_1044; 821_1045; 823_1034; 1047_1223 | 3.5E-107; 3.4E-25; 1.1E-36; 3.4E-25; 3.01E-23; 18.429; 1.2E-21; 3.4E-24; 3.6E-13; 7.3E-37; 2.8E-34; 2.83E-21; 12.746; 1.8E-26; 8.5E-42; 7.55E-50; 7.4E-83; 1.1E-43 |

Table 29: *arbitrary identifiers for the domains, which are further described in Table 30 below. **In some cases instead of an e-value there appears ";", which indicates that domain was verified by ScanRegExp, which is able to verify PROSITE matches using corresponding statistically-significant CONFIRM patterns (P-value of $10e^{-9}$).

TABLE 30

Details of Identified Domains

| Domain Identifier | IPR number | Accession number | Description of IPR |
|---|---|---|---|
| 1 | IPR027295 | G3DSA:2.140.10.10 | Quinoprotein alcohol dehydrogenase-like domain |
| 2 | IPR022768 | PF06268 | Fascin domain Fascin domain |
| 3 | IPR008999 | SSF50405 | Actin cross-linking |
| 4 | IPR013661 | PF08453 | Peptidase family M9 N-terminal Peptidase M9, collagenase, N-terminal domain |
| 5 | IPR022409 | SM00089 | PKD/Chitinase domain |
| 6 | IPR007280 | PF04151 | Bacterial pre-peptidase C-terminal domain Peptidase, C-terminal, archaeal/bacterial |
| 7 | IPR002169 | PF01752 | Collagenase Peptidase M9A/M9B, collagenase, bacterial |
| 8 | IPR000601 | PF00801 | PKD domain PKD domain |
| 9 | IPR008514 | G3DSA:2.30.110.20 | Type VI secretion system effector, Hcp |
| 10 | IPR025202 | PF13091 | PLD-like domain Phospholipase D-like domain |
| 11 | IPR001736 | PF00614 | Phospholipase D Active site motif Phospholipase D/Transphosphatidylase |
| 12 | IPR006315 | TIGR01414 | autotrans_barl: outer membrane autotransporter barrel domain Outer membrane autotransporter barrel |
| 13 | IPR005546 | SM00869 | Autotransporter beta-domain |
| 14 | IPR011658 | G3DSA:3.90.182.10 | PA14 domain |
| 15 | IPR005084 | PS51175 | CBM6 (carbohydrate binding type-6) domain profile. Carbohydrate binding module family 6 |
| 16 | IPR011042 | G3DSA:2.120.10.30 | Six-bladed beta-propeller, TolB-like |
| 17 | IPR008979 | G3DSA:2.60.120.260 | Galactose-binding domain-like |
| 18 | IPR010496 | PF06439 | Domain of Unknown Function (DUF1080) Domain of unknown function DUF1080 |
| 19 | IPR013783 | G3DSA:2.60.40.10 | Immunoglobulin-like fold |
| 20 | IPR003961 | PS50853 | Fibronectin type-III domain profile. Fibronectin type III |
| 21 | IPR006311 | PS51318 | Twin arginine translocation (Tat) signal profile. Twin-arginine translocation pathway, signal sequence |
| 22 | IPR015919 | SSF49313 | Cadherin-like |
| 23 | IPR008009 | PF05345 | Putative Ig domain Putative Ig |
| 24 | TPR000772 | PF14200 | Ricin-type beta-trefoil lectin domain-like Ricin B, lectin domain |
| 25 | IPR012341 | G3DSA:1.50.10.10 | Six-hairpin glycosidase |
| 26 | IPR008928 | SSF48208 | Six-hairpin glycosidase-like |
| 27 | IPR011050 | SSF51126 | Pectin lyase fold/virulence factor |
| 28 | IPR006626 | SM00710 | Parallel beta-helix repeat |
| 29 | IPR012334 | G3DSA:2.160.20.10 | Pectin lyase fold |
| 30 | IPR006530 | TIGR01643 | YD_repeat_2x: YD repeat (two copies) YD repeat |
| 31 | IPR031325 | PF05593 | RHS Repeat RHS repeat |
| 32 | IPR014756 | SSF81296 | Immunoglobulin E-set |
| 33 | IPR014766 | G3DSA:2.60.40.1120 | Carboxypeptidase, regulatory domain |
| 34 | IPR013784 | SSF49452 | Carbohydrate-binding-like fold |
| 35 | IPR002909 | PF01833 | IPT/TIG domain IPT domain |
| 36 | IPR003633 | PF03490 | Variant-surface-glycoprotein phospholipase C Phospholipase C, variant-surface-glycoprotein |
| 37 | IPR000909 | PS50007 | Phosphatidylinositol-specific phospholipase X-box domain profile. Phosphatidylinositol-specific phospholipase C, X domain |
| 38 | IPR017946 | G3DSA:3.20.20.190 | PLC-like phosphodiesterase, TIM beta/alpha-barrel domain |
| 39 | IPR029030 | G3DSA:3.40.50.1460 | Caspase-like domain |
| 40 | IPR020575 | PR00775 | 90 kDa heat shock protein signature Heat shock protein Hsp90, N-terminal |
| 41 | IPR003594 | G3DSA:3.30.565.10 | Histidine kinase-like ATPase, C-terminal domain |
| 42 | IPR028992 | G3DSA:2.170.16.10 | Hedgehog/Intein (Hint) domain |
| 43 | IPR022385 | TIGR03696 | Rhs_assc_core: RHS repeat-associated core domain Rhs repeat-associated core |
| 44 | IPR025968 | PF14431 | YwqJ-like deaminase YwqJ-like deaminase |
| 45 | IPR003587 | SM00306 | Hint domain N-terminal |
| 46 | IPR013320 | SSF49899 | Concanavalin A-like lectin/glucanase domain |
| 47 | IPR006558 | SM00560 | LamG-like jellyroll fold |
| 48 | IPR031329 | PF04734 | Neutral/alkaline non-lysosomal ceramidase, N-terminal Neutral/alkaline non-lysosomal ceramidase, N-terminal |
| 49 | IPR031331 | PF17048 | Neutral/alkaline non-lysosomal ceramidase, C-terminal Neutral/alkaline non-lysosomal ceramidase, C-terminal |
| 50 | IPR021865 | PF11962 | Peptidase_G2, IMC autoproteolytic cleavage domain Peptidase G2, IMC autoproteolytic cleavage domain |
| 51 | IPR024535 | PF12708 | Pectate lyase superfamily protein Pectate lyase superfamily protein |
| 52 | IPR010916 | PS00430 | TonB-dependent receptor proteins signature 1, TonB box, conserved site |
| 53 | IPR030934 | PS50818 | Intein C-terminal splicing motif profile. Intein C-terminal splicing region |

TABLE 30-continued

Details of Identified Domains

| Domain Identifier | IPR number | Accession number | Description of IPR |
|---|---|---|---|
| 54 | IPR024079 | G3DSA:3.40.390.10 | Metallopeptidase, catalytic domain |
| 55 | IPR008778 | PF05726 | Pirin C-terminal cupin domain Pirin, C-terminal domain |
| 56 | IPR012093 | PIRSF006232 | Pirin |
| 57 | IPR011051 | SSF51182 | RmlC-like cupin domain |
| 58 | IPR003829 | PF02678 | Pirin Pirin, N-terminal domain |
| 59 | IPR014710 | G3DSA:2.60.120.10 | RmlC-like jelly roll fold |
| 60 | IPR003284 | PF03534 | Salmonella virulence plasmid 65 kDa B protein Salmonella virulence plasmid 65 kDa B protein |
| 61 | IPR004302 | PF03067 | Lytic polysaccharide mono-oxygenase, cellulose-degrading Chitin-binding protein, N-terminal |
| 62 | IPR001579 | PS01095 | Chitinases family 18 active site. Glycoside hydrolase, chitinase active site |
| 63 | IPR011583 | SM00636 | Chitinase II |
| 64 | IPR029070 | SSF54556 | Chitinase insertion domain |
| 65 | IPR005135 | G3DSA:3.60.10.10 | Endonuclease/exonuclease/phosphatase |
| 66 | IPR017853 | SSF51445 | Glycoside hydrolase superfamily |
| 67 | IPR001223 | PF00704 | Glycosyl hydrolases family 18 Glycoside hydrolase family 18, catalytic domain |
| 68 | IPR009470 | PF06483 | Chitinase C Chitinase, C-terminal |
| 69 | IPR013830 | SSF52266 | SGNH hydrolase-type esterase domain |
| 70 | IPR013781 | G3DSA:3.20.20.80 | Glycoside hydrolase, catalytic domain |
| 71 | IPR013207 | PF08310 | LGFP repeat LGFP |
| 72 | IPR006584 | SM00606 | Cellulose binding, type IV |
| 73 | IPR012938 | PF07995 | Glucose/Sorbosone dehydrogenase Glucose/Sorbosone dehydrogenase |
| 74 | IPR029062 | SSF52317 | Class I glutamine amidotransferase-like |
| 75 | IPR011041 | SSF50952 | Soluble quinoprotein glucose/sorbosone dehydrogenase |
| 76 | IPR029010 | PF06283 | Trehalose utilisation ThuA-like domain |

Table 30.

Example 7

Gene Cloning for Expression in E. coli

Cloning of bacterial genes in *E. coli* for expression in *E. coli* Selected genes were synthesized by Genscript for expression in *E. coli*. The original sequences were modified such that the codons were optimized for protein expression in *E. coli* (further details are available at www(dot)genscript(dot)com/tools/codon-frequency-table) and a 6 Histidine coding sequence was inserted at either the 5' or the 3' end.

In cases where the original sequences already included a native signal peptide, such a native signal peptide was removed at a cleavage site separating the mature protein (i.e., which does not include a signal peptide) from the native signal peptide, and the mature protein was further modified by adding an artificial initiator Methionine immediately after the cleavage site.

All optimized genes were synthesized with 5' NcoI and 3' EcoRI restrictions sites, and in some of the genes as a result of the addition of the restriction site an additional glycine residue was added at the $2^{nd}$ position (after the initiator Methionine) in order to maintain the reading frame of the coding sequence.

Genes lacking an original (native) signal peptide were cloned into pET22bd (a modified version of pET22B+ in which the periplasmic signal peptide PelB [SEQ ID NO: 751] was removed).

Genes having an original (native) signal peptide that was replaced with an artificial signal peptide were cloned into either the pET22bd and/or the pET22B+(purchased from Merck Millipore, www(dot)merckmillipore(dot)com/INTL/en/product/pET-22b%28%2B%29-DNA---Novagen, EMD_BIO-69744?ReferrerURL=%3A%2F%2Fwww(dot)google(dot)co(dot)il%2F&bd=1#anchor Description) by digesting the gene and the vector with NcoI and EcoRI.

The sequence of each gene was verified by Sanger sequencing in each expression vector. All aforementioned modifications are summarized in Table 31 below.

In most cases, following the optimization the synthesized sequences exhibit at least 80% global identity to the curated sequences from which they were obtained. In two cases, MBI7 and MBI30, the optimized synthesized polypeptide sequences exhibit less than 80% global identity to the curated sequences from which they were obtained. For example, the polypeptide of SEQ ID NO: 568 exhibits only 76.6% global identity to SEQ ID NO: 251 which is the original curated sequence of MBI7 (given in Table 22 above). However, these polypeptides comprise the amino acid sequence of the derived polypeptides as set forth by SEQ ID NOs: 667 (MBI7) and 668 (MBI30).

TABLE 31

Details of Synthesized Sequences for *E. coli* Cloning

| # | Gene Name | Derived polypeptide Seq ID NO | Plasmid ID | Synthesized Seq ID NOs Nucl. | Synthesized Seq ID NOs Pep. | Modifications |
|---|---|---|---|---|---|---|
| 1 | MBI3 | 684 | 24505 | 535 | 591 | Native signal peptide removed; MetGly & 3' His-tag added |
| 2 | MBI4 | 680 | 24506 | 529 | 585 | Native signal peptide removed; Met & 3' His-tag added |

TABLE 31-continued

Details of Synthesized Sequences for E. coli Cloning

| # | Gene Name | Derived polypeptide Seq ID NO | Plasmid ID | Synthesized Seq ID NOs Nucl. | Pep. | Modifications |
|---|---|---|---|---|---|---|
| 3 | MBI7 | 667 | 24573 | 512 | 568 | Native signal peptide removed; pelB SP from vector backbone, Met & 3' His-tag added |
| 4 | MBI11 | 665 | 24508 | 508 | 564 | Native signal peptide removed; Met & 3' His-tag added |
| 5 | MBI13 | 664 | 24510 | 507 | 563 | Native signal peptide removed; MetGly & 3' His-tag added |
| 6 | MBI14 | 683 | 24511 | 534 | 590 | Native signal peptide removed; Met & 3' His-tag added |
| 7 | MBI17 | 255 | 24514 | 517 | 573 | 3' His-tag added |
| 8 | MBI18 | 256 | 24691 | 500 | 556 | 3' His-tag added |
| 9 | MBI22 | 661 | 24517 | 504 | 560 | Native signal peptide removed; Met & 3' His-tag added |
| 10 | MBI23 | 669 | 24587 | 514 | 570 | Native signal peptide removed; Met & 3' His-tag added |
| 11 | MBI23 | 669 | 24705 | 515 | 571 | Native signal peptide removed; pelB SP from vector backbone, Met & 3' His-tag added |
| 12 | MBI27 | 685 | 24519 | 536 | 592 | Native signal peptide removed; Met & 3' His-tag added |
| 13 | MBI30 | 668 | 24522 | 513 | 569 | Native signal peptide removed; Met & 3' His-tag added |
| 14 | MBI33 | 674 | 24525 | 523 | 579 | Native signal peptide removed; MetGly & 3' His-tag added |
| 15 | MBI34 | 673 | 24526 | 520 | 576 | Native signal peptide removed; Met & 3' His-tag added |
| 16 | MBI34 | 673 | 24558 | 521 | 577 | Native signal peptide removed; pelB SP from vector backbone, Met & 3' His-tag added |
| 17 | MBI35 | 682 | 24527 | 533 | 589 | Native signal peptide removed; Met & 3' His-tag added |
| 18 | MBI36 | 675 | 24528 | 524 | 580 | Native signal peptide removed; MetGly & 3' His-tag added |
| 19 | MBI39 | 658 | 24531 | 498 | 554 | Native signal peptide removed; Met & 3' His-tag added |
| 20 | MBI39 | 658 | 24560 | 499 | 555 | Native signal peptide removed; pelB SP from vector backbone, Met & 3' His-tag added |
| 21 | MBI42 | 266 | 24533 | 510 | 566 | 3' His-tag added |
| 22 | MBI43 | 660 | 24604 | 503 | 559 | Native signal peptide removed; pelB SP from vector backbone, Met & 3' His-tag added |
| 23 | MBI44 | 659 | 24548 | 501 | 557 | Native signal peptide removed; Met & 3' His-tag added |
| 24 | MBI46 | 269 | 24695 | 502 | 558 | Gly & 3' His-tag added |
| 25 | MBI48 | 671 | 24563 | 518 | 574 | Native signal peptide removed; pelB SP from vector backbone, Met & 3' His-tag added |
| 26 | MBI50 | 678 | 25128 | 527 | 583 | Native signal peptide removed; pelB SP from vector backbone, MetGly & 3' His-tag added |
| 27 | MBI51 | 676 | 24707 | 525 | 581 | Native signal peptide removed; pelB SP from vector backbone, Met & 3' His-tag added |
| 28 | MBI55 | 662 | 24566 | 505 | 561 | Native signal peptide removed; pelB SP from vector backbone, MetGly & 3' His-tag added |
| 29 | MBI61 | 274 | 24539 | 522 | 578 | 3' His-tag added |
| 30 | MBI63 | 656 | 24591 | 496 | 552 | Native signal peptide removed; Met & 3' His-tag added |
| 31 | MBI68 | 681 | 24699 | 530 | 586 | Native signal peptide removed; Met & 3' His-tag added |
| 32 | MBI68 | 681 | 24709 | 531 | 587 | Native signal peptide removed; pelB SP from vector backbone, Met & 3' His-tag added |
| 33 | MBI71 | 679 | 25113 | 528 | 584 | Native signal peptide removed; pelB SP from vector backbone, MetGly & 3' His-tag added |
| 34 | MBI72 | 663 | 25114 | 506 | 562 | Native signal peptide removed; pelB SP from vector backbone, MetGly & 3' His-tag added |

TABLE 31-continued

Details of Synthesized Sequences for E. coli Cloning

| # | Gene Name | Derived polypeptide Seq ID NO | Plasmid ID | Synthesized Seq ID NOs Nucl. | Pep. | Modifications |
|---|---|---|---|---|---|---|
| 35 | MBI73 | 279 | 24543 | 532 | 588 | Gly & 3' His-tag added |
| 36 | MBI75 | 657 | 25115 | 497 | 553 | Native signal peptide removed; pelB SP from vector backbone, MetGly & 3' His-tag added |
| 37 | MBI76 | 281 | 24545 | 511 | 567 | Gly & 3' His-tag added |
| 38 | MBI79 | 666 | 24572 | 509 | 565 | Native signal peptide removed; pelB SP from vector backbone, MetGly & 3' His-tag added |
| 39 | MBI82 | 677 | 25401 | 526 | 582 | Native signal peptide removed; pelB SP from vector backbone, Met & 3' His-tag added |
| 40 | MBI22_H2 | 693 | 26303 | 545 | 601 | Native signal peptide removed; MetGly & 5' His-tag added |
| 41 | MBI22_H3 | 695 | 26304 | 548 | 604 | Native signal peptide removed; MetGly & 5' His-tag added |
| 42 | MBI27_H1 | 689 | 26274 | 541 | 597 | Native signal peptide removed; pelB SP from vector backbone, Met & 3' His-tag added |
| 43 | MBI27_H2 | 696 | 26280 | 549 | 605 | Native signal peptide removed; pelB SP from vector backbone, Met & 3' His-tag added |
| 44 | MBI27_H2 | 696 | 26308 | 550 | 606 | Native signal peptide removed; Met & 3' His-tag added |
| 45 | MBI27_H3 | 686 | 26309 | 537 | 593 | Native signal peptide removed; Met & 3' His-tag added |
| 46 | MBI27_H4 | 694 | 26278 | 546 | 602 | Native signal peptide removed; pelB SP from vector backbone, Met & 3' His-tag added |
| 47 | MBI27_H4 | 694 | 26310 | 547 | 603 | Native signal peptide removed; Met & 3' His-tag added |
| 48 | MBI27_H5 | 697 | 26281 | 551 | 607 | Native signal peptide removed; pelB SP from vector backbone, Met & 3' His-tag added |
| 49 | MBI27_H6 | 691 | 27138 | 543 | 599 | Native signal peptide removed; Met & 3' His-tag added |
| 50 | MBI27_H7 | 692 | 27139 | 544 | 600 | Native signal peptide removed; Met & 3' His-tag added |
| 51 | MBI27_H8 | 688 | 27140 | 539 | 595 | Native signal peptide removed; Met & 3' His-tag added |
| 52 | MBI27_H10 | 690 | 27162 | 542 | 598 | Native signal peptide removed; pelB SP from vector backbone, Met & 3' His-tag added |
| 53 | MBI27_H11 | 687 | 27136 | 538 | 594 | Native signal peptide removed; Met & 3' His-tag added |
| 54 | MBI4_H4 | 296 | 26290 | 540 | 596 | Gly & 3' His-tag added |
| 55 | POCM19 | 672 | 24989 | 519 | 575 | Native signal peptide removed; Met & 3' His-tag added |
| 56 | POCM25 | 670 | 25170 | 516 | 572 | Native signal peptide removed; MetGly & 3' His-tag added |

Table 31. The modifications (e.g., removal of the native signal peptide, and/or the addition of methionine codon, or a MetGly coding sequence, and/or a 3' His-tag sequence) for expression in E. coli are indicated for each of the optimized sequences.
"Nucl" = nucleotide sequence; "Pep."—polypeptide sequence.

Example 8

Gene Cloning for Plant Expression

Plant Vectors

Genes to be expressed in Arabidopsis, Tomato and Soybean were synthesized by Genscript. The original sequences were modified such that the codons were optimized for protein expression in the different plants (further details are available at www(dot)genscript(dot)com/tools/codon-frequency-table) and a 6 Histidine coding sequence was inserted at the 3' of each gene.

In cases where the original sequences already included a native signal peptide, the native signal peptide was removed and an artificial initiator Methionine was added at the 5' end of the downstream mature protein.

Genes were cloned by either recombination or restriction enzyme-based methods, resulting with some genes having glycine added at the $2^{nd}$ position (after the initiator Methionine).

Arabidopsis and Tomato Binary Vectors

Genes introduced into Arabidopsis and tomato were cloned into pQT1 for attaining cytosol localization. Signal-peptide-less mature versions were also cloned into pQT2 for attaining apoplast localization. pQT1 and pQT2 are modifications of pGI, a plasmid constructed by inserting a synthetic poly-(A) signal sequence, originating from pGL3 basic plasmid vector (Promega, GenBank Accession No. U47295; nucleotides 4658-4811) into the HindIII restriction site of the binary vector (Clontech, GenBank Accession No. U12640) and by replacing GUS with GUS-Intron in the pBI101.3 backbone. In pQT1 and pQT2 the cassette between the left and right borders was inverted so the gene and its corresponding promoter became closer to the right border and the NPTII gene became closer to the left border. Both pQT1 and pQT2 contain a 35S promoter and a 5' UTR from the Tomato chloroplastic leucine aminopeptidase 2 gene (SEQ ID NO: 750; NCBI accession number: XP_015061189). pQT2 further includes an apoplast signal peptide derived from the tobacco gene PR1a (SEQ ID NO: 744; NCBI accession number: EF638827).

Soybean Binary Vectors

Genes introduced into Soybean were cloned into pZYI for attaining cytosol localization. pZYI is a modification of vector pZY101, where Ubiquitin9 promoter (SEQ ID NO: 740) and TVSP terminator (SEQ ID NO: 739) were inserted. Genes cloned into pZYI further comprise a 5' UTR from the Tomato chloroplastic leucine aminopeptidase 2 gene (NCBI accession number: XP_015061189) (SEQ ID NO: 750) and may or may not include a transit peptide to the chloroplast derived from the Arabidopsis RuBisCo small subunit 2A protein (SEQ ID NO: 737-738).

Maize Binary Vectors

The pTF1 and pTF2 vectors are modifications of vector pZY101.1 where a Maize Ubiquitin promoter and NOS terminator (SEQ ID NO: 733; NOS terminator is part of the vector, and it was also cloned for the expression cassette) were inserted. pTF2 contains additional restriction sites to allow cloning of a 2nd expression cassette (with the same promoter and terminator) into the vector. Genes cloned into the above further comprise a 5' UTR from the Maize RuBisCo small subunit 2A gene (SEQ ID NO: 741) and may or may not include a transit peptide to the chloroplast derived from the same RuBisCo small subunit 2A protein (SEQ ID NO: 742-743).

TABLE 32

Details of Synthesized Sequences for Plant Cloning

| # | Gene Name | Derived Seq ID NO | Plasmid ID | Host plant(s) | Seq ID NOs. Nucl. | Seq ID NOs. Pep. | Modifications |
|---|---|---|---|---|---|---|---|
| 1 | MBI11 | 665 | 26424 | Arabidopsis thaliana; Solanum lycopersicum | 608 | 632 | Native signal peptide removed; Met & 3' His-tag added |
| 2 | MBI13 | 664 | 26425 | Arabidopsis thaliana; Solanum lycopersicum | 609 | 633 | Native signal peptide removed; MetGly & 3' His-tag added |
| 3 | MBI14 | 683 | 27849 | Arabidopsis thaliana | 610 | 634 | Native signal peptide removed; Met & 3' His-tag added |
| 4 | MBI17 | 255 | 27850 | Arabidopsis thaliana | 611 | 635 | 3' His-tag added |
| 5 | MBI22 | 661 | 26426 | Arabidopsis thaliana; Solanum lycopersicum | 612 | 636 | Native signal peptide removed; Met & 3' His-tag added |
| 6 | MBI27_H3 | 686 | 27507 | Arabidopsis thaliana; Solanum lycopersicum | 613 | 637 | Native signal peptide removed; Met & 3' His-tag added |
| 7 | MBI33 | 674 | 27851 | Arabidopsis thaliana | 614 | 638 | Native signal peptide removed; Met & 3' His-tag added |
| 8 | MBI34 | 673 | 27852 | Arabidopsis thaliana | 615 | 639 | Native signal peptide removed; Met & 3' His-tag added |
| 9 | MBI35 | 682 | 26427 | Arabidopsis thaliana; Solanum lycopersicum | 616 | 640 | Native signal peptide removed; Met & 3' His-tag added |
| 10 | MBI39 | 658 | 27867 | Arabidopsis thaliana | 617 | 641 | Native signal peptide removed; Met & 3' His-tag added |
| 11 | MBI3 | 684 | 27853 | Arabidopsis thaliana | 618 | 642 | Native signal peptide removed; Met & 3' His-tag added |
| 12 | MBI42 | 266 | 26432 | Arabidopsis thaliana; Solanum lycopersicum | 619 | 643 | 3' His-tag added |
| 13 | MBI43 | 660 | 26428 | Arabidopsis thaliana; Solanum lycopersicum | 620 | 644 | Native signal peptide removed; Met & 3' His-tag added |
| 14 | MBI4 | 680 | 26429 | Arabidopsis thaliana; Solanum lycopersicum | 621 | 645 | Native signal peptide removed; Met & 3' His-tag added |
| 15 | MBI61 | 274 | 26430 | Arabidopsis thaliana; Solanum lycopersicum | 622 | 646 | 3' His-tag added |

TABLE 32-continued

Details of Synthesized Sequences for Plant Cloning

| Gene # | Name | Derived Seq ID NO | Plasmid ID | Host plant(s) | Seq ID NOs. Nucl. | Seq ID NOs. Pep. | Modifications |
|---|---|---|---|---|---|---|---|
| 16 | MBI27_H3 | 686 | 27718 | Arabidopsis thaliana; Solanum lycopersicum | 623 | 647 | Native signal peptid removed; pelB signal peptide, Met & 3' His-tag added |
| 17 | MBI11 | 665 | 26433 | Arabidopsis thaliana; Solanum lycopersicum | 624 | 648 | Native signal peptide removed; Met & 3' His-tag added |
| 18 | MBI13 | 664 | 26434 | Arabidopsis thaliana; Solanum lycopersicum | 625 | 649 | Native signal peptide removed; MetGly & 3' His-tag added |
| 19 | MBI22 | 661 | 26435 | Arabidopsis thaliana; Solanum lycopersicum | 626 | 650 | Native signal peptide removed; Met & 3' His-tag added |
| 20 | MBI35 | 682 | 26436 | Arabidopsis thaliana; Solanum lycopersicum | 627 | 651 | Native signal peptide removed; Met & 3' His-tag added |
| 21 | MBI43 | 660 | 26437 | Arabidopsis thaliana; Solanum lycopersicum | 628 | 652 | Native signal peptide removed; Met & 3' His-tag added |
| 22 | MBI4 | 680 | 26438 | Arabidopsis thaliana; Solanum lycopersicum | 629 | 653 | Native signal peptide removed; Met & 3' His-tag added |
| 23 | MBI35 | 682 | 28469 | Glycine max | 630 | 654 | Native signal peptide removed; Met & 3' His-tag added |
| 24 | MBI61 | 274 | 28470 | Glycine max | 631 | 655 | 3' His-tag added |

Table 32. The modifications (e.g, removal of the native signal peptide, and/or the addition of methionine codon, or a MetGly coding sequence, and/or a 3' His-tag sequence) for expression in plants are indicated for each of the optimized sequences. "Nucl." = nucleotide sequence; "Pep."—polypeptide sequence.

Example 9

Protein Expression and Purification in Bacterial Cells (Method 1)

Transformation of bacterial cells with the polynucleotides encoding the polypeptides having the ability to kill or inhibit the development of insects—Genes encoding unknown toxin candidate proteins were cloned in pET22/T7-lac promoter-based vector and coding DNA sequence was confirmed by sequencing. pET-based expression vectors were transformed into BL21 (DE3) E. coli host using heat shock method. After overnight growth in Terrific Broth (TB) medium at 37° C. in the presence of Carbenicllin (100 μg/mL), 5 mL starter cultures were used to inoculate 100 mL TB culture at $OD_{600}$ 0.05 in 0.5 L flat bottom flask. The cultures were allowed to grow until $OD_{600}$ ~0.5 (2-3 hours at 37° C. with 250 rpm). The incubator shaker temperature was reduced to 11° C., 16° C. or 22° C. and allowed cultures to grow for another 10 minutes and then Isopropyl β-D-1-thiogalactopyranoside (IPTG) was added at final concentration of 1 mM. The cultures were incubated further for 15 to 18 hours for target protein expression and then cells were harvested by centrifuging at 4,000 rpm/4° C./10 minutes. The cell pellet was washed with cold water containing 1 mM phenylmethylsulfonyl fluoride (PMSF) and stored at −80° C. until used for protein purification.

Bacterial cell pellet was lysed using bacterial protein extraction buffer (20 mM potassium phosphate pH 8.0, 300 mM NaCl, 0.1% triton X-100, 1 mM PMSF, 20 μg/mL DNAase I, 2 mM $MgCl_2$, 10 mM imidazole and 1 mg/mL lysozyme) at room temperature for 1 hour. The supernatant fraction (containing soluble protein) and pellet fraction (containing inclusion bodies and cell debris) of whole cell lysate was clarified by centrifugation at 4,000 rpm/4° C./25 minutes.

Purification of Expressed Recombinant Pesticidal Polypeptides:

Soluble Fractions—

The supernatant fraction containing soluble protein was incubated with Ni-NTA beads (washed with binding buffer prior to addition of supernatant fraction: 20 mM potassium phosphate pH 8.0, 300 mM NaCl and 10 mM imidazole) for 1 hour at 4° C. on a rotatory shaker with gentle shaker speed. The Ni-NTA-protein bound beads were collected by centrifugation at 1,200 rpm/4° C./5 minutes. The Ni-NTA-protein bound beads were washed with washing buffer (20 mM potassium phosphate pH 8.0, 300 mM NaCl and 20 mM imidazole) for 3 times. The bound proteins were eluted with elution buffer (20 mM potassium phosphate pH 8.0, 300 mM NaCl and 250 mM imidazole). The salts in the eluted proteins were removed using 0.5 mL Zebra Spin desalting columns equilibrated with 20 mM potassium phosphate pH 8.0. SDS-PAGE analysis was used to quantify protein using known concentrations of bovine serum albumin (BSA) as standard. The known concentrations of toxin candidates were used for bioassay.

Inclusion Bodies—

The pellet fraction containing inclusion bodies and cell debris was washed with 20 mM potassium phosphate pH 8.0 and 0.1% triton and then re-suspended in 20 mM potassium phosphate pH 8.0. Proteins in the inclusion bodies were quantified using 1:10 and 1:20 dilution on SDS-PAGE using known concentrations of bovine serum albumin (BSA) as standard. The known concentrations of toxin candidate in inclusion bodies were used for bioassay.

Preparation of Whole Cell Lysates from Bacteria Expressing a Polypeptide Having the Ability to Kill or Inhibit the Development of Insects—

In some instances, whole cell lysates carrying toxin candidate proteins as soluble and/or inclusion bodies were used in bioassays. The whole cell lysates were prepared by sonicating the bacterial pellets in 20 mM potassium phosphate pH 8.0 using the medium settings for 6 seconds with 2 minutes intervals on ice for 4-5 times. The expressed toxin candidates were analyzed on SDS-PAGE and concentration was estimated using known concentrations of BSA standard prior to bioassay.

Example 10

Topical Protein Assay (Method 1)

The following describes the validation assays using proteins expressed in bacterial cells (by method 1, Example 9 above) and provided as bacterial cell lysates, purified soluble proteins or inclusion bodies.

Qualifying the Ability of the Proteins to Kill or Inhibit the Development of Insects—

Protein samples were assayed by topical application onto insect artificial diet in a 96-well microtiter plate format in a method known to those familiar with the art [e.g., as described in Wei J Z et al., 2017 (PMID: 28796437), which is fully incorporated herein by reference]. In this procedure, 100 μl of artificial diet was added to each well of the microtiter plate prior to the application of samples. The outside wells of the plate were not used in the bioassay in order to avoid edge effects. Samples were submitted to the bioassay lab along with the relevant buffer negative control and positive controls.

Samples were added to 10 separate wells of the 96-well plate, corresponding to wells 2-11, in rows B through F. Negative control samples were added to wells G2-G6 and positive control samples were added to wells G7-G11. 15 μl of sample solution were applied to each well of the diet. After application, the plates were held for 30-45 minutes allowing absorption/drying of samples. Plates were then infested with the insect species of interest. In the case of lepidopteran insect test (Soybean looper, *Chrysodeixis includens* and Fall armyworm, *Spodoptera frugiperda*) infestation was accomplished through single insect transfer using a fine camel hair brush to pick up neonate insects and place them in the test wells. In the case of Western corn rootworm (*Diabrotica virgifera virgifera*), mass infest of an average 5 insects/well was performed. Following infestation, the plates were sealed with a microtiter plate mylar seal membrane which was then punctured above each well with a fine insect pin. The plates were then placed at the appropriate temperature incubator and held for 96 hours prior to scoring for response. Insect response was graded as normal (no response, "0"), stunting (moderate reduction in insect mass compared to negative controls, "1"), severe stunting (less than 20% the size of negative controls, "2"), or death ("3"). The 10 repeats were scored and analyzed by Fisher's exact test to determine differences between treatments and negative control. In the case of Southern green stinkbug (*Nezara viridula*) diet incorporation bioassays were conducted as follows: five $2^{nd}$ instar nymphs were added to a 30 ml plastic condiment cup. Insects were contained in the cup by a thinly stretched piece of Parafilm. The protein samples and artificial diet (Frontier Scientific) were applied to the Parafilm surface and then a second layer of Parafilm added to enclose the protein sample and diet. Insects were allowed to feed for 96 hours before evaluation. After 96 hours the insects were graded as alive or dead (insects which were unable to right themselves were considered moribund and were counted as dead). Mean comparisons were conducted using a one-way ANOVA (Dunnett's test) with a buffer sample as the control. A selection of bioactive proteins were further advanced to $IC_{50}$ determinations, as described below.

$IC_{50}$ Determinations

Protein samples were assayed by topical application to insect artificial diet in a 96-well microtiter plate format in a method known to those familiar with the art. In this procedure, 100 μl of artificial diet was added to each well of the microtiter plate prior to the application of samples. The outside wells of the plate were not used in the bioassay in order to avoid edge effects. Samples were submitted to the bioassay lab along with the relevant buffer negative control and positive controls. A serial dilution of sample was produced with 2 reduction in concentration at each step. A typical dilution series would be 1 mg/ml, 0.5 mg/ml, 0.25 mg/ml, 0.125 mg/ml, 0.062 mg/ml. In cases where lysates were used as the protein sample, the negative control was a bacterial lysate of a strain with an empty plasmid vector prepared at the same concentration as the highest lysate sample of the protein of interest.

Samples were added to 10 separate wells of the 96-well plate, corresponding to wells 2-11, in rows B through F. Negative control samples were added to wells G2-G6 and positive control samples were added to wells G7-G11. 15 μl of sample were applied to each well of the diet. After application, the plates were held for 30-45 minutes allowing absorption/drying of samples. Plates were then infested with the insect species of interest. In the case of lepidopteran insects test, infestation was accomplished through single insect transfer using a fine camel hair brush to pick up neonate insects and place them in the test wells. In the case of Western corn rootworm (*Diabrotica virgifera virgifera*), mass infest of an average 5 insects/well was performed. Following infestation, the plates were sealed with a microtiter plate mylar seal membrane which is then punctured above each well with a fine insect pin. The plates were then placed at the appropriate temperature incubator and held for 96 hours prior to scoring for response. Insect response was graded as normal (no response, "0"), stunting (moderate reduction in insect mass compared to negative controls, "1"), severe stunting (less than 20% the size of negative controls, "2"), or death ("3").

The 10 repeats were scored and analyzed by LL.4 (four-parameter log-logistic function). $IC_{50}$ was defined as the concentration of sample necessary to cause 50% of the test organisms to respond with a stunted phenotype after exposure to the sample.

Example 11

Diet Incorporation Protein Exposure to Stink Bug (Method 1)

The following describes the validation assays using proteins expressed in bacterial cells and provided as purified soluble proteins or inclusion bodies. Protein samples were assayed by integration into an insect artificial diet.

Five 2$^{nd}$ instar nymphs were added to a 30 ml plastic condiment cup. Insects were contained in the cup by a thinly stretched piece of Parafilm. The protein samples and artificial diet (Frontier Scientific) were applied to the Parafilm surface and then a second layer of Parafilm added to enclose the protein sample and diet. Insects were allowed to feed for 96 hours before evaluation. After 96 hours the insects were graded as alive or dead (insects which were unable to right themselves were considered moribund and were counted as "dead"). Mean comparisons between tested and control treatments were conducted using a one-way ANOVA (Dunnett's test) with a buffer sample as the control.

Example 12

Protein Expression and Purification in Bacterial Cells (Method 2)

Transformation of bacterial cells with the polynucleotides encoding the polypeptides having the ability to kill or inhibit the development of insects—Candidate genes were synthesized as described in Example 7 herein above "GENE CLONING FOR EXPRESSION IN E. COLI". Plasmids were transformed into chemically competent E. coli BL21 (DE3): Transformation was conducted by adding 1 µl of plasmid DNA to 50 µl of chemically competent E. coli BL21 (DE3) (New England Biolabs). DNA and cells were incubated on ice for 10 minutes, heat shocked at 42° C. for 15 seconds, suspended in 250 µl SOC recovery medium (20 g/L Tryptone, 5 g/L Yeast Extract, 0.5 g/L NaCl, 20 mM glucose) and incubated for 1 hour at 37° C. Cells (50 µl) were plated on LB (10 g/L Tryptone, 5 g/L yeast extract, 10 g/L NaCl) containing 100 µg/ml Ampicillin and grown overnight at 37° C. Colonies from the plates were used for shake-flask fermentation, as described below. Plates were stored in the fridge at 4° C.

A single colony from an LB plate was inoculated into 40 ml 2×YT auto-induction media (recipe shown below) in a 250 ml non-baffled flask. Cultures were incubated at 37° C. with shaking at 250 RPM for 16-18 hours. After incubation, cells were pelleted at 10,000 g at 4° C. and pellets were resuspended in 4 ml ice-cold 20 mM Tris-HCl, for a concentration factor of 10×. Cells were pelleted at 10,000 g and pellets were resuspended in 4 ml 20 mM Tris-HCl. Cells were lysed by sonication on ice at 40% power for a total time of 2:00 minutes in cycles of 7 second bursts and 20 seconds rest. Whole lysate was submitted for bioassay.

Verification of Protein Expression—

Expression of target protein was verified by SDS-PAGE analysis: A 100 µl sample of whole cell lysate was removed after sonication was completed. Insoluble proteins were assessed by removing 26 µl of whole cell lysate, to which 4 µl DTT reducing agent and 10 µl LDS sample buffer (Invitrogen) were added, heating at 70° C. for 5 minutes and loading 20 µl on a 10% Bis-Tris Novex (Invitrogen) gel with a dual colored protein standard for protein size determination. Soluble proteins were assessed by centrifuging the remaining 74 µl of whole cell lysate for 1 minute at 16,000 g. 26 µl of supernatant was combined with DTT and LDS (as above) and 20 µl loaded on to a 10% Bis-Tris Novex gel. Gels were run for 40 minutes at 200 volts and stained by Coomassie Blue (Invitrogen) as follows: 100 ml of COOMASSIE staining was added to the gel and heated for 15 seconds. Gel was incubated with light shaking for 15-30 minutes and rinsed 2× with DI water. Gels were destained by adding 50 ml DI (deionized) water, heating for 15 seconds, and incubating with light shaking for 15-30 minutes. Results were visualized on a light box and bands assessed based on predicted molecular weight.

Auto-Induction Media—2×YT Media Recipe:

16 g/L tryptone, 10 g/L YE, 5 g/L NaCl, 50 ml/L 20×NPS, 200 µl/L Metal Mix.

After autoclaving 10 ml/L Magnesium stock, 20 ml/L 50× '5052' (as described below) and 1 ml/L of 100 mg/ml Ampicillin stock;

50× '5052', per 100 ml—25 g glycerol, 2.5 g glucose, 10 g alpha lactose;

20×NPS, per L—66.1 g $(NH_4)_2SO_4$, 136.1 g $KH_2PO_4$, 142 g $Na_2HPO_4$.

Metal Mix, per 100 ml=1.352 g $FeCl_3*6H_2O$, 0.222 g $CaCl_2$, 0.198 g $MnCl_2*4H_2O$, 0.288 g $ZnSO_4*7H_2O$, 0.048 g $CoCl_2*6H_2O$, 0.034 g $CuCl_2*2H_2O$, and 0.053 g $NiSO_4*6H_2O$; It is noted that "g"=gram.

Example 13

Topical Protein Assay (Method 2)

This Example describes assays for validation of insect killing or inhibitory activity using whole bacterial cell lysates following expression of proteins according to method 2 (Example 12).

Insect Screening Assay on E. coli Lysates—

Activity against Cabbage Loopers (Trichoplusia ni) and Beet Armyworm (Spodoptera exigua) was tested on Diet Overlay Bioassays. The appropriate artificial insect diet was dispensed into each well of a standard 96 well plate and allowed to dry. Once the diet solidified, 100 µL of the treatment (E. coli lysate) was pipetted into the appropriate number of wells and allowed to dry. A single 1st instar larva was delivered into each well of a 96 well plate. Mortality was scored at 4 days after treatment.

Activity against Lygus (Lygus hesperus) was tested on an artificial diet bioassay as follows: Diet packets were prepared by combining the appropriate amount of Lygus artificial diet and stock treatment solution. The mixtures were vortexed and distributed evenly amongst the diet packets. Nymphs, 10-12 Lygus 2nd or 3rd instar, were placed into a petri dish, covered with a mesh lid and sealed with Parafilm. Mortality was scored at 4 days after exposure to the treated diet.

$IC_{50}$ Determinations—

$IC_{50}$ values (reflecting sample dilution) for Cabbage Loopers (Trichoplusia ni) were determined using diet overlay bioassays. The appropriate artificial insect diet was dispensed into each well of a standard 96 well plate and allowed to dry. Treatments (E. coli lysates) were serially diluted from 100% to 3.125% prior to treatment. Once the diet solidified, 100 µL of the treatment was pipetted into the appropriate number of wells and allowed to dry. A single 1st instar larva was delivered into each well of a 96 well plate. A total number of n=72 insects were used per treatment. Mortality was scored at 4 days after treatment. Data were analyzed using Probit analysis.

Insect Spectrum Testing—

Activity against Diamondback Moth (*Plutella xylostella*) was tested on Diet Overlay Bioassays. The appropriate artificial insect diet was dispensed into each well of a standard 96 well plate and allowed to dry. Once the diet solidified, 100 μL of the treatment was pipetted into the appropriate number of wells and allowed to dry. A single 1st instar larva was delivered into each well of a 96 well plate. Mortality was scored at 4 days after treatment.

Activity was tested against Green Peach Aphids (*Myzus persicae*) using a Fecundity Assay. Pepper plants approximately 2-3 weeks old were treated with a hand sprayer until the point of run off. Plants were allowed to dry on the bench top. Once the leaves were dry, 6 adult aphids were placed on the treated surface of the leaves and contained using clip cages. Total number of nymphs present were counted 4 days after treatment.

Example 14

In Vitro Protein Assay Results

The following Tables 32 and 33 summarize the validation results using bacterial cells over-expressing the polypeptides of some embodiments of the invention. The insect inhibition assays were performed using the soluble fraction, the inclusion bodies fraction or whole bacterial cell lysate of bacterial cells over-expressing the proteins according to "method 1" (Examples 9 and 10), or whole bacterial cell lysates of bacterial cells over-expressing the proteins according to "method 2" (Examples 12 and 13).

TABLE 33

Validation results for the ability of the polypeptides of some embodiments of the invention (prepared and assayed by method 1) to kill or inhibit the development of insects
Validation Data (Method 1)

| Gene name of p.p. over-expressed in bacteria | Bacterial isolate reference number | Target insect: *C. includens*/ *S. frugiperda*/ *D. virgifera*/ *N. viridula* | Protein Preparation | Treated, Scores (0-3) | Control, Scores (0-3) | P-Value |
|---|---|---|---|---|---|---|
| MBI11 | M979 | *C. includens* | Soluble protein | 1 | 0 | 1.67E−03 |
| MBI13 | M979 | *C. includens* | Inclusion bodies | 2 | 0 | 2.51E−02 |
| MBI22 | E132 | *C. includens* | Inclusion bodies | 3 | 0 | 1.94E−02 |
| MBI27 | B670 | *C. includens* | Inclusion bodies | 1 | 0 | 1.58E−03 |
| MBI43 | F427 | *D. virgifera* | Whole cell Lysate | 1 | 0 | 3.33E−04 |
| MBI35 | E128 | *C. includens* | Inclusion bodies | 1 | 0 | 2.25E−02 |
| MBI7 | M979 | *C. includens* | Whole cell Lysate | 2 | 0 | 1.31E−01 |
| MBI30 | B670 | *D. virgifera* | Whole cell Lysate | 3 | 0 | 2.06E−04 |
| MBI33 | E128 | *C. includens* | Soluble fraction | 2 | 0 | 7.26E−03 |
| MBI34 | E128 | *C. includens* | Whole cell Lysate | 1 | 0 | 7.99E−03 |
| POCM19 | G706 | *C. includens* | Inclusion bodies | 3 | 0 | 3.36E−04 |
| POCM25 | F427 | *C. includens* | Inclusion bodies | 2 | 0 | 2.60E−04 |
| MBI68 | E132 | *N. viridula* | Inclusion bodies | 0.6* | 1* | 8.20E−02 |
| MBI73 | E128 | *D. virgifera* | Whole cell Lysate | 1 | 0 | 1.08E−02 |
| MBI76 | F427 | *S. frugiperda* | Soluble protein | 2 | 0 | 4.49E−02 |
| MBI4_H4 | — | *C. includens* | Inclusion bodies | 2 | 0 | 3.96E−03 |
| MBI22_H2 | — | *C. includens* | Inclusion bodies | 2 | 0 | 1.08E−04 |
| MBI22_H3 | — | *C. includens* | Inclusion bodies | 2 | 0 | 4.44E−04 |
| MBI27_H1 | — | *C. includens* | Inclusion bodies | 3 | 0 | 1.08E−05 |
| MBI27_H2 | — | *C. includens* | Inclusion bodies | 2 | 0 | 1.08E−04 |
| MBI27_H3 | — | *C. includens* | Inclusion bodies | 2 | 0 | 1.08E−05 |
| MBI27_H4 | — | *C. includens* | Inclusion bodies | 2 | 0 | 1.08E−05 |
| MBI27_H5 | — | *C. includens* | Inclusion bodies | 2 | 0 | 2.17E−05 |
| MBI27_H6 | — | *C. includens* | Inclusion bodies | 1 | 0 | 1.19E−04 |
| MBI27_H7 | — | *C. includens* | Inclusion bodies | 1 | 0 | 3.36E−04 |

TABLE 33-continued

Validation results for the ability of the polypeptides of some embodiments of the invention (prepared and assayed by method 1) to kill or inhibit the development of insects
Validation Data (Method 1)

| Gene name of p.p. over-expressed in bacteria | Bacterial isolate reference number | Target insect: C. includens/ S. frugiperda/ D. virgifera/ N. viridula | Protein Preparation | Treated, Scores (0-3) | Control, Scores (0-3) | P-Value |
|---|---|---|---|---|---|---|
| MBI27_H8 | — | S. frugiperda | Inclusion bodies | 1 | 0 | 1.36E−03 |
| MBI27_H10 | — | S. frugiperda | Inclusion bodies | 1 | 0 | 7.00E−04 |
| MBI27_H11 | — | C. includens | Inclusion bodies | 1 | 0 | 1.83E−02 |

Table 33. Provided are the results of validation experiments, performed using various protein preparation methods: Whole cell bacterial lysate; insoluble protein fraction (inclusion bodies from bacterial cells); and purified soluble proteins from bacterial cells. The Table includes genes derived from bacterial isolates stated in the second column (e.g., M979) and homologues of such that were discovered as described in Example 5 and are named after their hook gene with the addition of the suffix "H" coupled to a serial number. For instance, MBI4_H4 stands for the fourth homologue of the hook gene MBI4 to be discovered. The "Treated Scores" refers to grading of the responses of all insects but N. viridula to the treatment: normal (no response, "0"), stunting (moderate reduction in insect mass compared to negative controls, "1"), severe stunting (less than 20% the size of negative controls, "2"), or death ("3"). "Control Scores" are the scores produced by buffer negative control treatments or bacterial lysate control treatment, to which tested purified soluble proteins & inclusion bodies, or whole cell lysates were compared, respectively.
*In N. viridula experimentation, only viability was scored and, therefore, the results given are of average survival: while the average survival of the control population is 1, average survival of the population exposed to MBI86 is 0.6.
"p.p." = polypeptide.

TABLE 34

Validation results for the ability of the polypeptides of some embodiments of the invention (prepared and assayed by method 2) to kill or inhibit the development of insects

| | | Target insect | | | | | |
|---|---|---|---|---|---|---|---|
| | | T. ni | | P. xylostella | | M. persicae | |
| Gene name of p.p. over-expressed in bacteria | Bacterial isolate reference number | % mortality (>30 is highly efficient) | Std Error | % mortality (>30 is highly efficient) | Std Error | Fecundity (No. of nymphs) (<18 is efficient) | Std Error |
| MBI4 | A190 | 53.6 | 15.51 | 47.62 | 4.76 | 18.5 | 3.17 |
| MBI11 | M979 | 42.03 | 5.86 | — | — | 14.67 | 3.34 |
| MBI13 | M979 | 42 | 11.72 | — | — | — | — |
| MBI22 | E132 | 42 | 15.51 | 30.77 | 6.73 | 16.67 | 1.17 |
| MBI27 | B670 | 36.23 | 5.86 | — | — | 18 | 3.33 |
| MBI43 | F427 | 45 | 15.28 | 42.86 | 9.525 | — | — |
| MBI61 | P243 | 41.7 | 4.60 | — | — | 17.5 | 1.34 |
| MBI35 | E128 | 44 | 28.64 | 40.66 | 2.11 | — | — |
| MBI42 | F427 | 19.3 | 12.72 | 40 | 2.87 | 12.33 | 3.5 |
| MBI03 | A190 | 47.8 | 10.15 | 28.58 | 14.29 | 18 | 1.92 |
| MBI7 | M979 | 34.4 | 18.08 | — | — | — | — |
| MBI17 | P63 | 30.6 | 15.57 | 30.77 | 2.56 | 17.84 | 0.96 |
| MBI30 | B670 | 47.8 | 10.15 | — | — | — | — |
| MBI33 | E128 | 59.4 | 21.11 | — | — | 15.17 | 2.89 |
| MBI34 | E128 | 24.64 | 8.95 | 24.6 | 26.6 | 17 | 3.03 |
| MBI39 | F427 | 30.4 | 10.15 | 26.38 | 12.09 | 16.66 | 1.10 |
| MBI79 | A190 | 34.4 | 18.08 | — | — | — | — |
| MBI14 | M979 | 43.2 | 14.41 | 41.03 | 7.69 | — | — |
| MBI18 | P63 | 40.17 | 4.99 | — | — | — | — |
| MBI23 | A918 | 38.87 | 7.33 | — | — | — | — |
| MBI36 | F427 | 36.2 | 15.51 | — | — | — | — |
| MBI44 | F427 | 31.59 | 9.15 | — | — | — | — |
| MBI46 | F427 | 43 | 20.76 | — | — | — | — |
| MBI48 | L219 | 48.4 | 11.84 | — | — | — | — |
| MBI50 | L219 | 38.46 | 7.10 | — | — | — | — |
| MBI51 | L219 | 42.4 | 17.56 | — | — | — | — |
| MBI55 | O180 | 24.7 | 13.82 | — | — | — | — |
| MBI63 | E128 | 53.6 | 25.55 | — | — | — | — |

TABLE 34-continued

Validation results for the ability of the polypeptides of some embodiments of the invention (prepared and assayed by method 2) to kill or inhibit the development of insects

| | | Target insect | | | | | |
|---|---|---|---|---|---|---|---|
| | | T. ni | | P. xylostella | | M. persicae | |
| Gene name of p.p. over-expressed in bacteria | Bacterial isolate reference number | % mortality (>30 is highly efficient) | Std Error | % mortality (>30 is highly efficient) | Std Error | Fecundity (No. of nymphs) (<18 is efficient) | Std Error |
| MBI71 | E128 | 52.3 | 22.81 | — | — | — | — |
| MBI72 | E128 | 35.69 | 9.82 | — | — | — | — |
| MBI75 | E128 | 33.7 | 14.58 | — | — | — | — |
| MBI82 | E128 | 38.55 | 3.15 | — | — | — | — |

Table 34: Validation results were performed using whole cell bacterial lysates (without further purification). The gene name describes the gene encoding the polypeptide which was over-expressed in the bacteria (Table 22). The second column describes the name of the bacterial isolate (e.g., A190, M979) from which the polypeptide was derived. The mortality rate is indicated. A mortality percentage higher than 30% (>30%; i.e., more than 30% of the insects die) is considered an efficient activity. A number of nymphs smaller than 18 (<18) is considered as an indicator for an efficient reduction in fecundity.
"p.p." = polypeptide;

Table 35 hereinbelow, summarizes the $IC_{50}$ results of the validation results obtained by method 1.

TABLE 35

| $IC_{50}$ results | | | | |
|---|---|---|---|---|
| General Information | | | Dose response (Method I) | |
| Gene name | Isolate | Target insect | Protein Preparation (Soluble, Insoluble) | $IC_{50}$ (mg/ml) |
| MBI11 | M979 | C. includens | Soluble | 16.04 |
| MBI13 | M979 | C. includens | Insoluble | 1.22 |
| MBI22 | E132 | C. includens | Insoluble | 8.5 |
| MBI27 | B670 | C. includens | Insoluble | 7.89 |
| MBI33 | E128 | C. includens | Soluble | 0.41 |
| MBI76 | F427 | S. frugiperda | Soluble | 0.23 |
| MBI27_H1 | — | C. includens | Insoluble | 0.004 |
| MBI27_H3 | — | C. includens | Insoluble | 0.04 |
| MBI27_H4 | — | C. includens | Insoluble | 1.18 |
| MBI27_H5 | — | C. includens | Insoluble | 0.05 |

Table 35: Provided are the $IC_{50}$ results of the validation assays. Validation experiments were performed using two protein preparation methods: Insoluble protein fraction (inclusion bodies from bacterial cells); and purified soluble proteins from bacterial cells. The Table includes genes derived from bacterial isolates stated in the second column (e.g., M979) and homologues of such that were discovered as described in Example 5 and are named after their hook gene with the addition of the suffix "H" coupled to a serial number, For instance, MBI27_H1 stands for the first homologue to be discovered of the gene MBI27).
"p.p." = polypeptide;

Table 36 hereinbelow summarizes the $LC_{50}$ results of the validation results obtained by method 2.

TABLE 36

| $LC_{50}$ results | | | |
|---|---|---|---|
| General Information | | | Dose response (Method 2) |
| Gene name | Isolate reference | Target insect | $LC_{50}$ |
| MBI4 | A190 | T. ni | 10.12% v/v |
| MBI11 | M979 | T. ni | 10.66% v/v |
| MBI13 | M979 | T. ni | 56% v/v |
| MBI22 | E132 | T. ni | 8.67% v/v |
| MBI27 | B670 | T. ni | 15.68% v/v |
| MBI35 | E128 | T. ni | 10.7% v/v |

TABLE 36-continued

| $LC_{50}$ results | | | |
|---|---|---|---|
| General Information | | | Dose response (Method 2) |
| Gene name | Isolate reference | Target insect | $LC_{50}$ |
| MBI42 | F427 | T. ni | 15.28% v/v |
| MBI43 | F427 | T. ni | 13.99% v/v |
| MBI61 | P243 | T. ni | 15.9% v/v |

Table 36: Validation results were performed using whole cell bacterial lysates (without further purification). The Table includes genes derived from bacterial isolates stated in the second column (e.g., A190, M979).

Example 15

Producing Transgenic *Arabidopsis* Plants Expressing Selected Genes According to Some Embodiments of the Invention Plant Transformation—

The *Arabidopsis thaliana* var Columbia ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues were the primary targets of *Agrobacterium*-mediated transformation by the *Arabidopsis* floral-dip method. Plant Physiol. 123(3): 895-904] with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Single colonies of *Agrobacterium* carrying the binary vectors harboring the genes of some embodiments of the invention were cultured in YEBS medium (Yeast extract 1 gr/L, Beef extract 5 gr/L, $MgSO_4*7H_2O$, Bacto peptone 5 gr/L) supplemented with kanamycin (50 mg/L) and gentamycin (50 mg/L). The cultures were incubated at 28° C. for 48 hours under vigorous shaking to desired optical density at 600 nm of 0.85 to 1.1. Before transformation into plants, 60 µl of Silwet L-77 was added into 300 ml of the *Agrobacterium* suspension.

Transformation of $T_0$ plants was performed by inverting each plant into an *Agrobacterium* suspension such that the above ground plant tissue was submerged for 1 minute. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

For generating Ti and T2 transgenic plants harboring the genes of some embodiments of the invention, seeds collected from transgenic $T_0$ plants were surface-sterilized by exposing to chlorine fumes (6% sodium hypochlorite with 1.3% HCl) for 100 minutes. The surface-sterilized seeds were sown on culture plates containing half-strength Murashig-Skoog (Duchefa); 2% sucrose; 0.5% plant agar, 50 mg/L kanamycin; and 200 mg/L carbenicylin (Duchefa). The culture plates were incubated at 4° C. for 48 hours and then were transferred to a growth room at 25° C. for three weeks. Following incubation, the Ti plants were removed from culture plates and planted in growth mix contained in 250 ml pots. The transgenic plants were allowed to grow in a greenhouse to maturity. Seeds harvested from Ti plants were cultured and grown to maturity as T2 plants under the same conditions as used for culturing and growing the $T_i$ plants.

Example 16

Producing Transgenic Tomato Plants Expressing Selected Genes According to Some Embodiments of the Invention Plant Transformation—

Cotyledons of *Solanum lycopersicum* var M82 were transformed using *Agrobacterium*-mediated transformation method described below.

Seeds of *Solanum lycopersicum* var M82 were surface sterilized using 3% sodium hypochlorite for 10 minutes followed by three washes by sterile distilled deionized water for 10 minutes each. Sterile seeds were sown in magenta boxes containing half-strength Murashige-Skoog (MS) salts including B5 vitamins); 2% sucrose; 0.5% plant agar. After 7 days of growth were prepared explants from cotyledons for transformation. Cotyledons were detached from the stems, cut in half, wounded and placed on the culture plates containing pre-cultivation media (MS salts and vitamins, 3% sucrose, 0.08% casein hydrolizate, 0.02% $KH_2PO_4$, 2 mg/l glycine, 0.5 mg/l biotin, 0.5 mg/l folic acid, 0.65% plant agar, 0.01 mg/l kinetin, 0.2 mg/l 2,4-D, 100 µM Acetosyringone, pH=5.8). Plates were incubated in dark at 24° C. for 24 hours prior transformation.

Single colonies of *Agrobacterium* carrying the binary vectors harboring the genes of some embodiments of the invention were cultured in LB medium (Hylabs #BP302) supplemented with 50 mg/l Kanamycin and 50 mg/l carbenicillin. The cultures were incubated at 28° C. for 24 hours under vigorous shaking and diluted to the desired optical density of 0.4 to 0.5 at 600 nm into transformation medium (MS salts including B5 vitamins, 3% sucrose, 100 µM Acetosyringone, 10 mM magnesium chloride, 10 mM MES, pH 5.8).

Transformation was performed by pouring an *Agrobacterium* suspension on the cotyledons for 50 minutes in the dark. After removal of *Agrobacterium* suspension, inoculated cotyledons were co-cultivated in the dark at 24° C. for 48 hours, including media replacement by the fresh one after 24 hours.

Transformed cotyledons were transferred into the culture plates containing selection media (MS salts, Nitch vitamins, 3% sucrose, 0.6% plant agar, 1 mg/l zeatin, 70 mg/l kanamycin, 200 mg/l ticarcillin, pH 5.8) and incubated in the growth room with regime 16 hours light and 8 hours dark at 24° C. for 2 weeks. After cultivation cotyledons were transferred into different selection media (MS salts, Nitch vitamins, 3% sucrose, 0.65% plant agar, 1 mg/l zeatin riboside, 90 mg/l kanamycin, 200 mg/l ticarcillin, pH 5.8) and cultivated for additional 2 weeks at the same conditions till plantlet appearance on the cotyledons.

Plantlets with true leaves were transferred into high plates containing elongation media (MS salts and B5 vitamins, 3% sucrose, 0.08% casein hydrolizate, 2 mg/l glycine, 0.5 mg/l biotin, 0.5 mg/l folic acid, 0.65% plant agar, 0.2 mg/l zeatin, 90 mg/fl kanamycin, 200 mg/l ticarcillin pH 5.8) and incubated at the same conditions for 2 weeks for shoot development.

Plantlets with developed real leaves were transferred into high containers containing rooting medium (MS salts and B5 vitamins, 3% sucrose, 0.08% casein hydrolizate, 2 mg/l glycine, 0.5 mg/l biotin, 0.5 mg/l folic acid, 0.65% plant agar, 1 mg/l IBA, 100 mg/l kanamycin, 150 mg/l ticarcillin pH 5.8) for 2 weeks for root development.

Developed transgenic plants were removed from culture plates and planted in growth mix in 25 L pots. The transgenic plants were allowed to grow in a greenhouse to maturity, Ti seeds were collected from the ripen fruits and stored.

Example 17

Production of Transgenic Soybean Plants Expressing Selected Genes According to Some Embodiments of the Invention Plant Transformation—

Cotyledonary nodes of *Glycine max* cultivar Jack are transformed using *Agrobacterium tumefaciens* mediated transformation method described in Paz et al. 2006 (Improved cotyledonary node method using an alternative explant derived from mature seed for efficient *Agrobacterium*-mediated soybean transformation. Plant Cell Rep, vol. 25, 206-213).

Soybean seeds are surface sterilized for 16 hours using chlorine gas produced by mixing 3.5 ml of 12 N HCl and 100 ml sodium hypochlorite in a tightly sealed desiccator. Disinfected seeds are soaked in sterile water overnight in the dark. Seed coats are removed from the imbibed seeds and cotyledons are separated using scalpel. Axial shoot/bud is removed and the junction between the cotyledon and hypocotyl is wounded by making five slices using scalpel.

Cells of *Agrobacterium* carrying the binary vectors harboring the genes of some embodiments of the invention are cultured on medium containing Tryptone, Yeast Extract, NaCl, D-mannitol, MgSO4*7H2O, K2HPO4 and L-Glutamic acid supplemented with appropriate antibiotics for 24 hours at 28° C. Grown cells are collected by loop and diluted to the desired optical density of OD=0.6 at 660 nm into transformation B5 medium (as described in Paz, Margie M., et al. "Improved cotyledonary node method using an alternative explant derived from mature seed for efficient *Agrobacterium*-mediated soybean transformation." Plant cell reports 25.3 (2006): 206-213). Wounded cotyledons are immersed in the bacterial suspension for 30 minutes at room temperature. After inoculation are cotyledons placed adaxial side down on co-cultivation medium (as described in Paz, Margie M., et al. "Improved cotyledonary node method using an alternative explant derived from mature seed for efficient *Agrobacterium*-mediated soybean transformation." Plant cell reports 25.3 (2006): 206-213). Co-cultivation is performed at 24° C. for 5 days in the growth room with photoperiod of 18 hours. After co-cultivation explants are pushed deeper by the wounded side into solidified shoot inducing medium with BASTA selection and cultivated at 24° C. for 14 days. Explants are transferred to the fresh shoot inducing medium after removing and discarding shoots from the apical area. Explants are cultivated at 24° C. for additional four weeks, including additional cleaning and transfer to the fresh media after two weeks. After shoot induction cotyledons are removed from the explants and explants are transferred on shoot elongation medium for two weeks at 24° C. Tissue is transferred to the fresh shoot elongation medium every two weeks till the elongated shoots are received (as described in Paz, Margie M., et al. "Improved cotyledonary node method using an alternative explant derived from mature seed for efficient *Agrobacterium*-mediated soybean transformation." Plant cell reports 25.3 (2006): 206-213).

Received shoots are transferred to rooting medium containing IBA (Indole-3-butyric acid) 1 mg/L without selection and cultivated at 24° C. for 14 days or until roots develop.

Rooted and developed plants are removed from the rooting medium, washed with water and transplanted into the supplemented soil in 25 L pots. Plants are grown in the greenhouse for approximately 3-4 months until pod harvesting.

Example 18

Production of Transgenic Maize Plants Expressing Selected Genes According to Some Embodiments of the Invention Plant Transformation—

Immature embryos of *Zea mays* genotype Hi-II are transformed using *Agrobacterium tumefaciens* mediated transformation method described in Ishida Y., et al. 2007 (*Agrobacterium*-mediated transformation of maize. Nature Protocols, vol. 2, 1614-1621).

Maize plants are grown in the greenhouse in 25 L pots. Temperature is maintained between 20-25° C. during nighttime to 30-35° C. during daytime with high light intensity and a photoperiod of 12 hours. Crosses between male and female florets are performed and 12 to 15 days after pollination ears containing immature embryos are harvested. Kernels are detached from the cob by cutting the base of the kernel with a scalpel. Immature embryos are removed from the kernel and immersed into LS-infection medium (as described in Ishida et al. (2007), supra). After collection, are embryos centrifuged (2,700 rpm for 5 seconds, at room temperature) and washed 2 times with 2 ml of LS-infection medium and incubated in water bath for 3 minutes in 46° C. followed by incubation on ice for 1 minute. Centrifuged embryos (20,000 g for 10 minutes at 4° C.) are ready for inoculation by *Agrobacterium*.

Cells of *Agrobacterium* carrying the binary vectors harboring the genes of some embodiments of the invention are cultured on a medium containing Tryptone, Yeast Extract, NaCl, D-mannitol, MgSO4*7H2O, K2HPO4 and L-Glutamic acid supplemented with appropriate antibiotics for 24 hours at 28° C. Grown cells are collected by loop and diluted to the desired optical density of OD=1.0 at 660 nm into transformation medium LS-inf-AS (as described in Ishida et al. (2007), supra). Bacterial suspension (1 ml) is added to the centrifuged embryos, vortexed for 30 seconds and incubated for 5 minutes at room temperature.

Embryos are transferred to fresh LS-AS solid medium with scutellum facing up and co-cultivated at 25° C. for 7 days in the growth room with a photoperiod of 18 hours (as described in Ishida et al. (2007), supra).

Selection is performed on LSD1.5A for 7 days at 28° C. (as described in Ishida et al. (2007), supra). After that, the explants are transferred to LSD1.5A medium with BASTA selection compound. Embryos are incubated at 28° C. for an additional 21 days. Only embryogenic calli that proliferated from scutellum are transferred to fresh LSD1.5A medium and incubated at 28° C. for 21 days.

Regeneration of calli is initiated by transferring to LSZ medium without any hormones and incubation in continuous light at 25° C. for 14 days (as described in Ishida et al. (2007), supra). Regenerated shoots are transferred to MS medium (Murashige and Skoog medium, Duchefa Cat: M0222) in magenta boxes and incubated at 25° C. for 14 days.

Rooted and developed plants are transferred from the magenta boxes to the supplemented soil in the 25 L pots and grown in the greenhouse for approximately 3-4 months in the same conditions as described above until seed harvesting.

Example 19

Plant Validation Assay

Tomato and *Arabidopsis* Validations

Transgenic *Arabidopsis thaliana* (ecotypes Columbia and Landsberg erecta) and Tomato (*Solanum lycopersicum* cultivar M82) were evaluated for insect resistance. Seeds were germinated on tissue culture medium (half-strength Murashige-Skoog (MS) salts including B5 vitamins; 2% sucrose; 0.5% plant agar; 50 mg/L kanamycin for *A. thaliana*; 100 mg/L kanamycin for Tomato. Transgenic *Arabidopsis* plants were identified by having dark green coloration and by continuing to further develop on the tissue culture medium. Transgenic Tomato plants were identified as those having green cotyledons and developing true leaves. Transgenic plants were transferred to standard potting mix soil, as they were moved to a quarantined greenhouse facility for hardening and growth. When reaching the desired developmental stage (described below), plants were assayed for insecticidal activity both ex vivo (detached tissue and fruits) and in vivo (whole plant assays), as described below.

Ex Vivo Bioassays

Detached *Arabidopsis* Leaf Bioassay:

Rosettes of early bolting *Arabidopsis* seedlings were picked and used for setting detached leaf bioassays with Fall armyworm, Corn earworm, Black cutworm, European corn borer and Cotton leafworm. Each transgene was represented by five different events. 8-9 plants were sawn per event to support 9 separate bioassay replicates. Each replicate was set and experimented as follows: 2-3 detached leaves were laid on 60 mm Petri dish containing 12 ml 0.65% plant agar in inverted position, so the upper part of the leaf faced the agar. After capturing the plate, it was infested with 3 $1^{st}$ instar neonates and incubated for 96 hours at 27° C. By the end of the incubation period, neonates' viability & weight data were collected and the leaves were captured again. Leaf eaten area ($cm^2$) was computationally extracted by superimposing the images taken before and after the treatment. Neonates' viability and weight and the leaf eaten area data were analyzed by one-way ANOVA (Dunnett's test) in an attempt to show statistically significant difference between transgenic lines and the wildtype, serving as a negative control. Results are summarized in Table 37.

TABLE 37

Reduced Leaf Eaten Area of Transgenic *Arabidopsis* Lines as Compared to Wildtype *Arabidopsis* plants 96 hours post-infestation with Lepidopteran species

| Gene name | Construct ID | Event | Target insect | % Leaf Eaten Area as compared to WT | P-Value |
|---|---|---|---|---|---|
| MBI11 | 26424 | 101175.1 | S. littoralis | 56.3 | 0.047 |
| MBI11 | 26424 | 101177.1 | S. frugiperda | 24.7 | 0.010 |
| MBI11 | 26424 | 101177.4 | S. frugiperda | 45.7 | 0.187 |
| MRI11 | 26424 | 101178.4 | S. frugiperda | 42.6 | 0.177 |
| MRI11 | 26424 | 101179.3 | H. zea | 23.3 | 0.019 |
| MRI11 | 26424 | 101179.3 | S. frugiperda | 40.6 | 0.112 |
| MBI13 | 26425 | 101180.1 | H. zea | 64.3 | 0.131 |
| MBI13 | 26425 | 101182.4 | H. zea | 20.0 | L |
| MBI13 | 26425 | 101183.4 | H. zea | 36.8 | L |
| MBI22 | 26426 | 101190.2 | H. zea | 47.9 | 0.010 |
| MBI22 | 26426 | 101190.2 | S. littoralis | 54.7 | 0.029 |
| MBI22 | 26426 | 101190.2 | S. littoralis | 31.1 | L |
| MBI22 | 26426 | 101190.5 | H. zea | 31.6 | L |
| MBI22 | 26426 | 101190.5 | S. frugiperda | 23.8 | 0.003 |
| MBI22 | 26426 | 101191.3 | S. littoralis | 52.8 | 0.018 |
| MRI22 | 26426 | 101191.3 | S. littoralis | 57.8 | 0.064 |
| MBI22 | 26426 | 101191.5 | H. zea | 28.4 | L |
| MBI22 | 26426 | 101191.5 | S. frugiperda | 22.1 | 0.002 |
| MBI22 | 26426 | 101193.1 | S. frugiperda | 45.5 | 0.136 |
| MBI22 | 26426 | 101193.1 | S. littoralis | 62.3 | 0.140 |
| MBI22 | 26435 | 101196.1 | S. littoralis | 36.1 | 0.010 |
| MBI35 | 26427 | 101105.2 | H. zea | 62.7 | 0.154 |
| MBI35 | 26427 | 101105.5 | H. zea | 38.6 | 0.001 |
| MRI35 | 26427 | 101105.5 | S. frugiperda | 22.6 | 0.004 |
| MBI35 | 26427 | 101106.3 | H. zea | 57.2 | 0.078 |
| MBI35 | 26427 | 101106.3 | H. zea | 57.5 | 0.074 |
| MBI35 | 26427 | 101107.3 | H. zea | 33.6 | 0.001 |
| MBI39 | 27867 | 101897.2 | S. littoralis | 58.3 | 0.028 |
| MBI39 | 27867 | 101898.2 | S. littoralis | 52.9 | 0.007 |
| MBI43 | 26428 | 101128.1 | S. frugiperda | 51.6 | 0.133 |
| MBI61 | 26430 | 101140.2 | H. zea | 56.2 | 0.052 |
| MRI61 | 26430 | 101141.1 | H. zea | 30.3 | L |
| MRI61 | 26430 | 101141.1 | H. zea | 47.4 | 0.015 |
| MBI61 | 26430 | 101142.2 | H. zea | 53.0 | 0.060 |
| MBI61 | 26430 | 101143.3 | S. frugiperda | 58.7 | 0.066 |

Table 37. Provided are relative percentages of eaten leaf areas of different transgenic *Arabidopsis* lines, as compared to the eaten leaf area of the wild type *Arabidopsis* that is regarded as 100%. Detached leaves were infested with $2^{nd}$ instar *Spodoptera frugiperda*, *Spodoptera littoralis* or *Helicoverpa zea* larvae. Eaten leaf area was analyzed four days post infestation. Plasmid ID refers to the constructs presented in Table 32. Event ID indicates the transgenic source of the experimented seedlings.
"L"—P < 0.001.

Tomato Fruit Bioassay

Reddish Tomato fruits are picked and used for setting fruit bioassays with Cotton leafwrom and Southern green stink bug. Each transgene is represented by five different events. Two plants are sown per event to support four separate replicates, two replicates per plant. Each replicate is set and experimented as follows: a reddish tomato fruit placed in a plastic cup is infested with 5 $2^{nd}$ instar neonates and incubated for 4-6 days at 27° C. By the end of the incubation period, neonates' viability and weight data, and in the case of Stink bug—also number of fruit piercings, are collected and analyzed by one-way ANOVA (Dunnett's test) in an attempt to show statistically significant difference between transgenic lines and the wildtype, serving as a negative control.

Whole Plant Validation Assay Against *Trichoplusia ni* (Cabbage Looper) and *Myzus persicae* (Green Peach Aphid)

Tomato and *Arabidopsis* transgenic plants were evaluated for resistance to *Trichoplusia ni* (*T. ni*) and *Myzus persicae* (*M. persicae*). Tomato and *Arabidopsis* plants were infested with 10-30 or 3, respectively 1st instar *T. ni* per plant. Two rates (10 and 30) were utilized in the case of Tomato plants to represent both high and low disease pressure scenarios. Infested Tomato plants were maintained in insect cages in a greenhouse environment and infested *Arabidopsis* plants were maintained in a conviron under the same light cycles as utilized for seed germination and growth. Plants were evaluated one week post-infestation and ratings were assigned visually based on chewing damage and defoliation of transgenic plants.

Tomato transgenic plants were also evaluated against *M. persicae*. Tomato plants were infested with 10 adult *M. persicae*. Infested plants were maintained in insect cages in a greenhouse for seven days. After seven days, population surveys were taken and the number of adults and nymphs was recorded.

Results are summarized in Tables 38-41.

TABLE 38

Damage rating (1-100%) of transgenic *Arabidopsis* plants seven days post-infestation with 3 1st instar *T. ni* larvae per plant

| Gene name | Construct ID | Event | Damage Rating | P-Value |
|---|---|---|---|---|
| WT | n/a | Col-O | 92.11 | n/a |
| MBI4 | 26429 | 101139.1 | 81.67 | 0.179 |
| MBI11 | 26424 | 101177.4 | 30 | n/a* |
| MBI11 | 26424 | 101175.1 | 83.33 | 0.136 |
| MBI11 | 26424 | 101170.2 | 83.33 | 0.136 |
| MBI11 | 26424 | 101173.1 | 81.67 | 0.179 |
| MBI11 | 26424 | 101171.5 | 81.67 | 0.179 |
| MBI11 | 26424 | 101170.6 | 88.33 | 0.055 |
| MBI11 | 26424 | 101170.1 | 86.67 | 0.076 |
| MBI13 | 26425 | 101185.3 | 33.33 | 0.005 |
| MBI13 | 26425 | 101185.5 | 88.33 | 0.055 |
| MBI13 | 26425 | 101188.7 | 86.67 | 0.076 |
| MBI22 | 26426 | 101193.3 | 23.33 | L |
| MBI22 | 26426 | 101196.5 | 33.33 | 0.005 |
| MBI42 | 26432 | 101117.3 | 35 | 0.026 |
| MBI42 | 26432 | 101115.2 | 33.33 | 0.005 |
| MBI42 | 26432 | 101115.3 | 85 | 0.102 |
| MBI42 | 26432 | 101115.2 | 83.33 | 0.136 |
| MBI43 | 26428 | 101124.2 | 50 | 0.156 |
| MBI61 | 26430 | 101142.1 | 45 | 0.064 |
| MBI61 | 26430 | 101142.2 | 38.33 | 0.160 |

TABLE 38-continued

Damage rating (1-100%) of transgenic *Arabidopsis* plants seven days post-infestation with 3 1st instar *T. ni* larvae per plant

| Gene name | Construct ID | Event | Damage Rating | P-Value |
|---|---|---|---|---|
| MBI61 | 26430 | 101142.3 | 33.33 | 0.005 |
| MBI61 | 26430 | 101140.5 | 86.67 | 0.076 |

Table 38: *sample size of one for this event due to plants dying, excluded from statistical analysis. Damage was evaluated visually, based on percentage of total leaf surface damaged by *T. ni* larvae.
"L"—P < 0.001

TABLE 39

Damage rating (0-5 scale, with 5 representing the highest damage) of transgenic *Solanum lycopersicum* plants seven days post-infestation with 10 1st instar *T. ni* larvae per plant

| Gene name | Construct ID | Event | Damage Rating | P-Value |
|---|---|---|---|---|
| WT | n/a | Col-O | 2.78 | n/a |
| MBI35 | 26427 | M-82_40_17 | 1.17 | 0.125 |
| MBI42 | 26432 | M-82_41_25 | 2.5 | 0.115 |
| MBI61 | 26430 | M-82_34_07 | 1 | 0.066 |
| MBI61 | 26430 | M-82_56_01 | 1.5 | 0.125 |
| MBI61 | 26430 | M-82_56_02 | 0.83 | 0.032 |
| MBI61 | 26430 | M-82_56_08 | 0.83 | 0.032 |

Table 39: Damage was evaluated visually, based on a 0-5 rating scale of severity with 5 representing the highest damage.

TABLE 40

Damage rating (0-5 scale, with 5 representing the highest damage) of transgenic *Solanum lycopersicum* plants expressing target proteins after infestation with 30 *T. ni* per plant.

| Gene name | Construct ID | Event | Damage Rating | P-Value |
|---|---|---|---|---|
| WT | n/a | Col-O | 3.48 | n/a |
| MBI35 | 26427 | M-82_40_26 | 3.17 | 0.038 |
| MBI35 | 26427 | M-82_61_08 | 3.33 | 0.117 |
| MBI42 | 26432 | M-82_41_41 | 2.67 | 0.124 |
| MBI42 | 26432 | M-82_41_10 | 2.67 | 0.124 |
| MBI43 | 26428 | M-82_42_01 | 2.5 | 0.041 |

Table 40: Damage was evaluated visually, based on a 0-5 rating scale of severity with 5 representing the highest damage.

TABLE 41

Adult and nymph populations of *M. persicae* on transgenic *Solanum lycopersicum* plants expressing target proteins after infestation with 10 *M. persicae* per plant

| Gene name | Construct ID | Event | Number of Adults | P-Value Adults | Number of Nymphs | P-Value Nymphs |
|---|---|---|---|---|---|---|
| WT | | Col-O | 4.81 | n/a | 37.5 | n/a |
| MBI22 | 26426 | M-82_39_07 | 2 | 0.033 | 20.67 | 0.002 |
| MBI22 | 26426 | M-82_39_12 | 0.33 | 0.033 | 16 | 0.003 |
| MBI22 | 26426 | M-82_39_15 | 0 | 0.058 | 8 | 0.221 |
| MBI22 | 26426 | M-82_53_02 | 0 | 0.033 | 1 | 0.024 |
| MBI22 | 26426 | M-82_60_02 | 0 | 0.159 | 2.67 | 0.041 |
| MBI35 | 26427 | M-82_40_02 | 0.33 | 0.058 | 14 | 0.138 |
| MBI35 | 26427 | M-82_40_09 | 1 | 0.159 | 26 | 0.934 |
| MBI35 | 26427 | M-82_40_11 | 0.33 | 0.058 | 9 | 0.033 |
| MBI35 | 26427 | M-82_40_17 | 1 | 0.159 | 6 | 0.012 |
| MBI35 | 26427 | M-82_61_08 | 0.67 | 0.099 | 11.33 | 0.068 |
| MBI61 | 26430 | M-82_34_14 | 1.33 | 0.243 | 7 | 0.017 |
| MBI61 | 26430 | M-82_56_02 | 4 | 0.43 | 11.33 | 0.068 |
| MBI61 | 26430 | M-82_56_03 | 0 | 0.033 | 6 | 0.012 |
| MBI61 | 26430 | M-82_56_11 | 0 | 0.033 | 3.67 | 0.005 |
| MBI61 | 26430 | M-82_58_30 | 0.67 | 0.099 | 7.33 | 0.019 |

Example 20

Soybean and Maize Validations

Transgenic Soybean (*Glycine max* L., cultivar Jack) and Maize (*Zea mays* line B104) seeds are germinated on tissue culture medium (half-strength Murashige-Skoog (MS) salts including B5 vitamins; 2% sucrose; 0.5% plant agar, 4 mg/L Basta) and identified already at the juvenile phase via the expression of the selection marker bar gene using AgraStrip® LL strip test seedchek (Romer labs). Authenticated transgenic plants are transferred to standard potting mix soil for hardening and growth. During plant growth plants are sampled again and transgene presence is validated by PCR. When reaching the desired developmental stage, seedlings, detached tissues (leaves, pods, roots etc.) are used for setting in vivo or ex vivo assays, respectively. In each bioassay, a transgene is represented by five events. The transgenic plants or the detached tissues are incubated with the target insects for 4-10 days, after which insect mortality and stunting as well as plant damaged tissues are evaluated. Data are collected and analyzed by one-way ANOVA (Dunnett's test) in an attempt to show statistically significant difference between transgenic lines and the wildtype, serving as a negative control.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

REFERENCES (ADDITIONAL REFERENCES ARE CITED IN TEXT)

Ishida Y., et al. 2007. "*Agrobacterium*-mediated transformation of maize". Nature Protocols, vol. 2, 1614-1621;

Paz et al. 2006. *Improved cotyledonary node method using an alternative explant derived from mature seed for efficient Agrobacterium-mediated soybean transformation*. Plant Cell Rep, vol. 25, 206-213;

APPENDIX

Attached herewith is an Appendix with 8 deposit confirmations for the following bacterial isolates as obtained from the NRRL depository:

*Bacillus thuringiensis* M979 having an NRRL Accession No. B-67457;

*Streptomyces scopuliridis* F427 having an NRRL Accession No. B-67458;

*Bacillus subtilis* P243 having an NRRL Accession No. B-67459;

*Stenotrophomonas maltophilia* E132 having an NRRL Accession No. B-67460;

*Massilia aurea* P63 having an NRRL Accession No. B-67461;

*Streptomyces* sp. E128 having an NRRL Accession No. B-67462;

*Streptomyces mirabilis* B670 having an NRRL Accession No. B67463;

*Bacillus amyloliquefaciens* A190 having an NRRL Accession No. B-67464;

SEQUENCE LISTING (764 sequences)

SEQ ID NO: 1 - DNA, 753 bp, Bacillus Sp.
atgatgtgtaaaaagctgttcaaagccgtcctcccgtttgccctgtcattcaccatggttctgtcattctccggtatgaatgtaaaagcgaaagaaaaagagacagcccgctacgcaaaagaaatcgcagaccttcagcagggcacgactcctcaagacgttctccaatccgccaaagagcttgccaaacagaagcacgtttcaacagaagcaattctcaagcagtttcatcaagaaatcacagcagacaaggtgcaaggaaatgtaatcgtttccaaagaagggctctctgcaatgggcggatcatcaggcacaaaaaaacttccgaaaagcacgaaaggcaatatttattacacgaactcatacacggcttattacaaccacgggcatgtcggcatgtattcatccgctgataaaattgttgaatccgtgccgggagacggcgtccgccagattgcttataacggcagggaagtcgaagacaattcaatcgtccagacggtgaaagtcactgatgcccaaaaacaagccgccgctgactgggccgtatcaagagtgggggatgaatactccttcaacttcgtcaataacagaaatacgggccatgaaggcgccaaaaactgctcaaaactgctgtggtcggcattccttttaaaagccgggattgatatcgactctaacggcggcttaggcgtatatccgcgcgacatcacaagctcgtcctacacaaccacgattctgaccattcactaa

SEQ ID NO: 2 - DNA, 1164 bp, Bacillus Sp.
gtgaaaaaaatcatctggatacccttagtgatcatcgccgccgcagcggtcttatgcttcttctatttccgcacggaagaccctgcggaggttgatagggacacattaaatgaccctgattttctgaaagataaagaggcgctgctgtatttctccactgcggctgaccaagacacgttcggcggcggaaaaagctacgccatcttcgccgatgaaaaaggacggctttcttcttatcacatgaaggggcttgagctcggatcggccaaagtgcatgacggcagcgtgctgcttgaggacaaaaaaggaatctacaccgttcagggcggccttcacacgtataaaagagcgtaccagcatacgggagacagcgcgggatatatcgagcggacgaaaggcttttacacgctgtataattcgggctacgacaagagcggcggcagctaccgctcagagctgtaccgccagattgacggcaagtggaagcaaaacgtcatcccgcactatatccgcgcttcaggcttttttaaagatcatcttttcgcactcacgccgacagatgacgaaaaaggctatcacgtccaagacattcaggccgataaagaaaagctccatacaacatcaatcgcgacatggacgtacaaagaaggcacgtctgtcgaatcccagctcgcagcggacgacagcgccgtctgctttgtcaccagaggggaaaaagcagatcacatctatcaaatggtgaaagtcatgaaaaacagcggcgccatcaaaacgtatgacatcgccgcttataaaaatgacgaacagacgatctatgactccatgccgttcagcttcaaaaaaagctttttcatggagcggcgcagcttctatttcgttgacggcttcggaaccgtctaccgcatcaaccctaagaccggaaaaagcaaaaaagccttcgccctccccgcatcccgaatgaaagccgacttcaaggagctgacccatcaaaacggaaagctgtatctgttcacgtacagctacaaaaagcccgccaaaatcgaatctttcgacctgaaaacgggcaaaaaactgaacgaccgaaccatcccaaacttaaaaaacatcgtcacgccgaaaagccatctcaagctgtatgatgtgcaggtgatgggcgggttttga

SEQ ID NO: 3 - DNA, 549 bp, Bacillus Sp.
atgaagaggttcataacacgtgcaagtggtaatacaatctcaaaaaagttagttttaatgatgttgccgatggttttaatgatattgatgattacaccatcgaatgatgtatcggcagcaaatctatcaagagcaggttcactaaaaggcgtgaatttatttaatggaagttggacagttgctatacaggcagcaaatttacaatatgtttctgctgagccatcgggtaatgtagtagcaaatcgtaatgcagttaatgaatgggagaaatttgaattaattccgactggggaattatatacgtttgctttaaaagcaaaaagtaatggaaagtacgtttcgtttgagccaaacggtagagtagtagcagatcgtacatcaattggggcatgggaaaaatttatcttatataatggtggagacaataggatatatgtattacaagcactaagtaatggtaggtttatatcagcaaatggtggtagagaattaactgctaatagttatgtagctggaagttgggaaagatttgttattgtatacttctaa

SEQ ID NO: 4 - DNA, 2916 bp, Bacillus Sp.
atgaaaggctattcaaagaaaatgttagtaggggtaagttttgctagtttaatgttagggagttttcaaggggtaagtttggcagaagatactaagggagagcaagtttcttatcgaaatgtgctcaaaatggagccagtcggtgtacaactaccagtacaagaattagctcattcatcgaaagtgctcgaaagcaagtcttttgagaaaaggttacaatttgccgatttatcacaaagaccacctgaggtgaaaaaagaaagtaagcaattagctgtagcgaaaacttatacaattgccgaattaaatcaattaagcaatcagcagttagtagatttacttgtaacaattgattgggagcaaattacggggctatttcagtttaatacagacagtctagcattctatcaaaatgatagtaggatgcagacgattattgataaattgaagcagcaaggacaagcctatacgaaggatgattcaaaagggattgagacattagtagaggtattacgttcaggattttatttaggattttataattcggaacttagtaaattaaatgaacggagttatcatgataaatgcttacctgcattaaaagcgatggctaacaattcaaattttaagctgggtacattagagcaaaatagagtggtatcatcatacggaaagttaataggaaacgcttcgagcgatgtggaaacgataacatcggctgcaaagatttttaaacaatataatgataatttttctacattagtagataatctttcagctggaaatgctatttacgatattatgcaaggtgttgattacgacattcaatcgtatttgtacgatacgaggaaagcaccgaaagatacagtatggtatcagaaaatagatagttatattaatgaattaagtcgttttgcattaatgggaacgattacagcaaaaaacggttggcttattaataatggcatttattatacaggtagactcggtatgttccatagtacaggaactaaagggttacaagttgtaacagatgcgatgaaaatgtatccgtatttaggggagcaatatttcgtagctgctgagcaaattgcaacgaattatggcggaaaagatgcaaatggtaaagtggtgaatttagatcaaataagagaagatggaaagaaaaaatatttgccaaaaacgtatacgtttgatgatggagcaattgttttaaaagctggagataaagtgacagaagaaaaagtaaaacgtttatattgggcggcaaaagaagtaaaggcacaattccatcgtacggttgaaagtgatcaacctttagaaaaaggaaatcctgatgatgtattaacgatggttatttataatagcccagcagaatatcaatttaatcgtcaattgtacggttatgaaacgaataacggtggtctttatatagaaggaacaggtacgttctttacttatgagcgtacgccagaagaaagtatttatagtttagaagaattattcagacacgagttcacgcattatttacaaggtagatatgaagtaccagggttatggggacaagggaaaatatatgaaaatgaaagattatcttggtttgaagaaggaaatgctgaattttttgcaggggcaacgagaacggataatgttgtaccgagaaagagtattataggaggattatcttcaaatccagcagagcgttatacggcagagcgaacgttaaatgcaaagtatggaacgtgggatttctataattattcctttgctttacaatcgtatatgtacaataagagatatgatatgttcgataaaatacatgatcttattaggaaaaatgatgtaacagcatatgatgcatatcgctctacattaagtaaagatgcgaatttaaataaagaatatcaggactatatgcaaatgctagttgataatcgtgagaaatataatgtgccattagtatcagacgattatttagcgaatcatgcatcgaagccagtttcagatattgcagcagaaataacagcggaagcaaaattgaaaaatgtatcagtgaagaaaaataaaccacagttctttaatacattcacactacaaggaacatatacaggaactgcagcaaaaggagaatatgaagattggaaaacaattacacaaaacgttaatgatacgttaaaacgtttaagtgcaaaggaatggacaggctataaaacagtaacagcatactttgtaaattatcgcgtgaatacatcaggacaatttgaatatgatgttgtgttccacggtattaatacagaagaaggtgcagagaataaagcaccagttgcagttataaacggtccgtatagcggaaatgtaaatgaagcaatttcatttacaagcgacggatcaaaagatgaagacgggaaaattacttcgtataaatgggagtttggtgatggagcagtaagtaatgagcaaaatccaactcacgtatatacaaaagaaggaacgtatacgacgaaattaacggtaacagacgataaaggagcaactaatactgctacagcgactgtaactgttcaaaagaaagaagataacagtgtagaaaaagaaccgaataactcattccaaacagcaaacaaattgcagttaaatcaagttttacgtgctagtttaggaaatggcgatacaagtgatttctttgaaattaatgtggagactgctaaaaaccttcaaattaacgtaacgaatgaaaataatattggaatgaactgggtactttattctgaagcagatttaaataattatgttacgtatgctcagcaacaagggaataaactagtaggtagttactatacgtatccagggaagtattatttacatgtgtatcagtatggcggggggacagggaattatacggtggaagtgaagtag

SEQ ID NO: 5 - DNA, 2349 bp, Bacillus Sp.
atgaaattaaaaagaggtttactatttatttgtacttcaactatgcttgctataccaagtatggcaagtgctaaaaacaacgatgtcccattctataacggtcaaaatgattcgtttttaacttcacttaacttacagttgccaggaaaatattatagacctggaagtggatatgcagctaaagaatctttatacagggccgatgtgcactttcctgcagtatataacggctcttttaattgggataacccaagggagaatttagtacaagctgaagatacttcagagccgtatattcgaattgcaaatgaaggttatttaaatagtaaagtaccagcgggtgaccgtatggtgactgaagtagaaagggttaataattctgttatttctagtaaatattggggaaacccagaattcgttttagaaaatatggataaacatatgatacaaacttatgaaagttttagagaacttggacagttttattggattcgtgacattgcatatctttctggtggatacgctggtgctagtggtgtaggtaatataaataaatatagcctgtggtatgtacgtacaagtaaacctcaagtaaaagactttcaagctatgagtggaaaaaaagatatacctgttaaatttacatttaaaggttttgagtatgtaagtaaaaataaaggatacaatgaccgagatcccaatggaacaacagtaaacccttatcaaaaagctgctggagaacggaaccgagttaaatggatgttagatattacaaaagatggtgaaaccgtgtatcaccaagaaaattatctgcgttcaactccacaaaaagataaccaaaaaccaaatgaaggagatgcagggcaatttaaaaaagaagatataacctggcagccgcaattgtgtgggcaatatactgcgaaaattaaagtcctagatgctgttcagagggaatcaaatgagaaagctgttgatttcaccattgatggcaactgcggtactgaagtaacacctaacccagatccaggtgatgaagatgactttaaatataaaattgatttctctgctgaccgaattgaaggagaaacagcaagagaaggaaagaatatcaaaacaagagtagatgtatcacgtgataattttaaactagagcgtgatcaatatagagcaaaagtaaacaacaatattaataagtcacagcaagaaataaacagcactgaatctgatagagatagtgcacaatccagcttaagttattgtcgtcgcaatccaattcatgaagtagatgccgagggaaaggatcactattatgatagagactgctcttgggaagaaaataaattagatagtgcagcaagtaagctagataatgcaagacagaaactagaaaaagagaagaataaaattaaaaagttagatgtattagaagaaaaatatatgaatcctgaaacagtagttgtgttaaaacataacggacaacaagtagctttacaaaaggtaagattaactgagggagaaaagaaaaccctgaaccttgactggcaacataaaggtaaaggaacaattcaagcggaaattaaccctgctggtaaccgtatagacatcgaggaaactacatacaaaaataatcctattaaaacagcaatctatgagccttcaaaagaaaaggcaatgtgtggtgtaacgagtgtaaaaggtgtagtagaaacagtaagtgaacgtgtatcaaaagaagatataactggggcaatgtattatgaaactttgacagggagtattggtaatttagctccttctaagctacattctggttatggattttcgtatgaagtaaacggtaagtacaaaaatgattggaatgcgaattaccctggtgtatttactgctgctaaggcacaatacccatttgcagacgaaggattaaagtctactcaagatttagagaagaaagaacttaaagatactacagcgaaattcctacctaaaaatatgtatttatctgaagcaacaggacatgtttttgatagtaaaagaccaactaagtctttatattgggatggacaagagaaaatcattgatggtggccaaaaatggtattcaccactgaagacaaaaaatggtgtatacacttttaatgtagaaacagctccagcaggtatcaatgaaatgagtttatgtttaactgagcaagtagagattaagggtgttgcgtatgatgatttcataaaaagaagagtatttcctgacgatccattccctggaggaagtggagttggttggaattgggttggtaaggaagatgtactttataaattaacagattggtattacatgagaaataggaaatga

SEQ ID NO: 6 - DNA, 4257 bp, Bacillus Sp.
ttgtggtttagaaggtcatttagtttactatttgttgttatgcttctgtttggaagcttggccgactttgtatcaattggacatgcagaaagtacatcggaccagaaacaggctcaagagaaaaaaacggacgatgtgactgtgctgcaagaaaaatctgatctgaagagtacgggaactaatccaagcgaggtagttgtagcaaatggtaaaaaaggtagtgagttgtttgattttgaagcctttattaagccttcagacattgtagatggaacagcaccttttgattcgaatgatgaagcaggtaatgattctagccctaataatggcattgtaaggacgtttgatacagtaacgtacccattgaaagtgacgattaatcctaagaagaatgaaacgttaaaaaatattaagatgaaaatcactggtacattagaaaatggaattacaaacaagcgtgttaatgcaaaatttgctgttggtggtaaagaggatttggaaaagggtattgtttcttttgatatggaatacacgttaaaggaaacaggtaactccttaatgattcctgttacggtggaagtacaaggggcggagcatggattgaaattaaagcctaacattaaaatccaggttataagtgtagatgggaaagatattgcaaatgaaaatgtatcgcaatcatttgatggtattagtcccgttactacttcaggaaaggttaatgtaaaggctcgctttactgcttcttatggtggaatgcctagattggattataaggtttatgatcccaatgcaaaagaggatgatcgtacaatcatatatccagttgctttagatttatttgtaaataatttaccaaaccgaactgatttacgaggagctacattccctgctggaaagattaattatcactttaatttttcaggaaaagtcgattgggattataaatcgttaggtgcagaaacattgaattttgagggtcgggataaaccgataaagatctttaactatcaggctattgataaaatagtagataaagtgccacaagaaggtacggaaagttttgaaattggtatgaagggctataaagatcctcgtactgagacagcaaacagtcctaaatcatatattccaaaagatatatggaatgctagtgatattgataaatacacgattgacagtgtatgggatagtggaacagtacgtttgaataaaccagaaattacaaaggatcgtgtaggttatacgggtagtatagaagactatgtaattggttcaactttcccaacgatgatgtcaaggccaggttattcagtaattcctaccttcggaaagaatgaaaaagcattttcaagcacacgtttcttaatacattcaacaaatgaatattatcctgtactgggtaaaaataataaggataatctaccgaataatgttttttattatttagaatttgttattgattcttatgaggatggcaagggtaatacaattccttataacactgttggaagatacacgcttaccgaaaggaataaccctaaaggtgcatactccatacaaactacattccatacaacagatcataaggagttaggtacaccaaatgttggctatagcgctgtatctaaaggagatccaacagttatagtaggacaaaatgtaaaagtcgttagtcatttgaatgttcgtgctgttacagaaggtggtacaacgatgatttataagtggaatacagattcgttttatctatctaaaaatagtgcggaaacagctaggaagaacatgttaaacgaggggtatcccaacacttctgcgggaagggttacaaatagtgataaacaaaaaatctattttggaatatctaaaaaaggagataattcttttgaaacactaacccaaaacaaagatgaggattatgattggtatagcacatatgatgaagcaaagaaacaaggtgaagtagctgctatcaaaaatgatattaatgcatctatgggggatggtgaggttgtagcatggaatattccattagaggtaaaaacaaagaaaataggtagtgttaatgaaaaaggaacgccaaacataacggttacggattcaatagtgtatccttcagctgatagaaaagtgggttatcgagtacgtggtgaagggaaatataataactttactgagtatgatgaaaagggaaatataacaaaactgcaatctcctgtaggaagtactgtgaattttgaaacgctaggcattatgaatggtgagacgagtagtgatgtgaaaacaaataaaaatacttactacagttcagataatgttagtgtaaccgttgataatttagtaaagttacctgatgcaatggattataattcattagatgaaaaagtagaaatgagagtgaaaataccaaaaggtcttgattatgtggttggttctgctaaatatggtgatcagtatatcgaaccaaaaattgagcaacaaaatgatggaagtaatcatttgatttggcatgacacattgactcgtggtaataaaacgctcaaaaaaatcaactttgagacaagaattaatcctgtactacttccgcaaggaaatcaggtaggtttggaaattacgaatgttcttagtagtgcgatggacacaagggcagaaaaatttaggacaagttctaagaatatttcagttgtgaaaattggtatggttggtgttagtgaaacaattgagaaagtgacagggaaaaagaacagtgactatgtggtcggtgttcaaccgtatacgacaatcaaagatgagtcacatattaaggcacttacatatgttccaagaaataaggatcataatggatctgcttttaatggtgttactttcttgagacaaatagcactagaaaatgctaataataagaacgttgaaatatggcttaataacagctttgttgaatcaaataatccaaacaaaattgatttaaagtcaaatggttggtataggtatacaggagagcaggatctatcaaaagtggtctctattttgctgtatataaatgattcattaagtagcagcgatattgtaaaaatgaatcttgtttacggcacacataaaaatgaatttggagatttttacgtaagtaaaacagtggtaaatacctctgttgattacaaattatctcctgtttctaaccaggtgaaatatacaattgtagcagatgcaaatttaggtcttagaaaaataagaatcgatactgcacctgctgatattggtttgccagtaattgtacgtttagacaaggacatcatttatgaggactctaataagagtaatgttgctgttaacttatatgataagtctgataataagttggtagacagtaaagtatatacaattcaggaattaccggaggaaataaaattcaaggtagatcctaaatttttaaagaaaaataataagagaaactacgaggttagatttgaaaaagtcaataaagaatctatttttatcgtagatgggaaaggaaaagtagatacggatggttatacttcttctgaagaaactgtaaaggcaaatacaaaagcatctactgagttaaaatataaaggcgttataatgacggagcgtgaagtcggaaaagagatggaagtcttttatgaaacacttacaattccgttaaaacagctacctaaacaaaaaactggctatggttttgagttgaaaccattagttagttataacaatgaattagcggtttcttatgatgttaagacaaatgctttagtagataagagattaattgattctcatttgaattatgagaaaaaaggtgatcaatttgttgttcctttagaagaagctgagaaaacaggcagcacggacaaaaagaacactgattatctttttgaattgccacatattaatgtggaacaaaaaacgggtaatttatttacagaccaacaagtaaaagaccatgatccacgtattaagaatgcaataaaggatgggaagcgaaagttatatgttcctatttgggcagatctgggagaatacaacgttttaatagtatcgggaatccctataggcgctaataaagttaactttgaggtaacacaaccattaaatttatatgcatatatgtacgggacaattggctcgaaaaccctggaagatgatgaattactgttagagcctgttgatccaaaaaatcctttctcaaatggcaaaccgcctggttggtcagatgtagatgttgcttggttaaagcaatag

SEQ ID NO: 7 - DNA, 492 bp, Massilia Sp.
atggcaatcgacgtatacctgcaaattgatggcatcaagggcgagtccaccgacaccgcgcacaaagactggatcgaatgccgttcggtgcagtgggaagtgctgcagccgaagtcggcaaccgcatcgaccggcggcggccacaccgccgagcgcaccgagcacaaggacatcgtggtgtccaagctggccgacctggcaaccccgctgctgctgcaaaactgctcgtcgggcaagaccattccgaaggccaagttcgaattcctgcgcgctgacggccagggcgagcgcatcaagtatttcgagatcgaactcgaaaacgtcctgatcagcaacgtggcgccgtcggtcaacgccggcgacatcctgtcggaaagcctggcgctgaagtactccaaggtcaagtggaagtacacccagcaaaaggtcggcggcggttcgggcggcaacacctcgggcggctgggatctatcggccaacaagaccgcctga

SEQ ID NO: 8 - DNA, 3057 bp, Massilia Sp.
atggcaagcaagaatatttcacaactggtaagcagcgacggcaattctagcgccccagcgacctctgcaccgggatgttttgtccatgatggtgaatcgatagaggggtttccaaacaagtggggaaagatattctctgatccgcacaaaggaaatcaggtcgaattctacttcaccggtgaccagtatttctcgacagttgctaaggccatcctcgatgcgaaagaaacggttttcatcactggctggcaagtcaatttcgacgtcgaattgacttccgaaatgacactgtatcaatgccttgaaactgcgatagacaaaaatcctaagctacagatttacgtaatgccttggttgtcgccaaaggtcggcgtcgacacaggcgacttcgaaaccatgttggcagtatttcaactgaattcgggcttgccggcaccggcacgagcattcgcgctgccggccattgcacagagcgatcaaaaaggtggcttgggcatcggtttctcgcatcatcagaaactggtggtgattgacaataaaaaggcctttgttggaggaatcgatctggcctacggtcgtcgggacaatggcaggttttctctgagccacgatggtagagtcggaaatgagctctacaatacctgcatcccggcagtccatcaaatgaccaaagtagaacagggcaagtatcttacccgtgccgagctcttggccgcttgtttcgacggaaaatttggcaaaatatcaacatttgcaacctctgcccctgctgagccaattgcaaaactgcaggataaattacaagttattagcgacgccggtgctgatctcacaaaacgaatttctgacaaatggaactctagcaaattgttgccggagtttgtcggaaaattggcggacatgcctgtcgacgcggcgcagaccgcgtcacgctgggcattttcgcgtttggatgcgagcgttgttgacaagatcgacggattgcgcacgatgggcactgcgcatgcgacagatgccgagacggccttggtagcgtggctgaatcacacttcgctagaacgcttgcccgcgtcactacgtgccacgactgtagagttgatcgaaacgttcaccatagcgacgttgagttacctatccaacatggcgaacacgcgctcggcgcgctatgaaaatttgcggaacttacgaaagatcgtacccgccagtggcaaagtgatcagtactagccagccacgcatgccgtggcatgacgtgcattgctcgatagtcggtccctccgtaagcgatttgagccgaaacttcattcaacgctggaacggtctcgccgtccgctatgaaaggtctcatggccgtattgttcggccccatgcactgcgccaggtatttgccagtctgggtctgccctcgatcgcgccagtcaagttgccgcgcatcgcacccgcggcgcttccctcgacacaagcgagacccggcaaggcttgggtacaggtacttcgaagtgcaccagttcggctcctggccgatgaaaaggcgggcaccgcgcacaaaagcgactcggcgccttcaccaactattgctgaaaacaactgcctgaaggctatgttaacggcgattagtggagcccaaaaattcatttacatcgaaggtcagtttttccagtctgctcatggcggcaagaacactgagatggagagcatagcgggtccgatgcagacattgctcgatgtcaccaagacccgtggttataagaaatatgccgagcagcttggaatcaaaggggtgccgccacaaaagatgctggcaaagttgcgctggtctcaaatcgatgatgtgaaagctgacattcagggcggaggggctgattttataaacgaccttaatgcgattattgccaatcatgcctcgatcgaagcaacgcgcgcattgggccctgccgacaaggcaatcgccaacccgatcggagaagctttagcgctcaggatcgaaggcgcaatccaagatggcctgccgttccatgtctatcttatcgtgccggtgcatccagagggcacactgaatacactgaatatcatgacgcaactgcatctgacaatgcagtcgctggtatttggtaggtttagtctggtgaatcgaatccggcgcgctctgcttgttcgagatttgcgaatgagtaaaaaaatgacattgacagatgccaagaaagtggtcgccggttattccttgcttagattggaacaagaggtacaagatgaatggtcggatcacctcactttgttgaatctgcggtcatggcagatgcttggtggccgtcctgtaacagagcaaatatacgtgcattcgaagctactggtggcagatgatagggtcgccattttgggcagtgccaacattaacgatcgcagtctgcttggtgaccgtgattccgaactggcagtggtcatacgcgacgatgcacagatcgatgtcaagttgaacggtatcgacagcgagccggtgagtgcaagtgtccacaagctacgcactggattgtggagaaagctgttcggaatgaccgatggcgcaacgcccgctaccgaattatcgactgtgatcgggacgcctgcggcggagggggcttggttggcgatacagaaaaccgcgcgtgtgaatgccgaggcatattccaaggcctttccatttttggctaacgttaaaggtgagccaagctcgatctggcctgtatggaatcgtgaccagttgtgtctgaaatttcagatgccgttcgatgagcggttctggcgcaaggcagaggtgcgggatccttcgttctcttggaatgcagagcaacgggcgccggagtcggctccggtcggcgtaaaaggatttattgtagcgttaccggttacttggaccgctggcgaagacaacatttcaggtatgaacttgactttgcttgcagaacataatcaggagccagctactctcgatcagagcgagccttcaggcaatggtctacgttacgctaaaggtaattcattggatcaagccaatgaaggcgaatcgaccagtgcggtttaa

SEQ ID NO: 9 - DNA, 2871 bp, Stenotrophomonas Sp.
atgaagcattcgaagttgagcctggccctggccgggctgatcgccgttggcgccatcgcggcggctgatgacgtcatggcaatgagttatcacgtgcagggggatcgcatcttcctgagcggcggggtgacctacgccgatgtggtgtcgttgcccgcgttgctggccaaggcacaggccgagggccggccgatccgcgaagtggtgctgcgcacctccaatggtggcgcgctgatcgccggcgagtggctgcagggcgtgatccgcacgtccggcctgaacaccatcgtgtccggccactgcatttcgtcctgctcgatcatgcagtccggtggcgtcgaacgctatctggccggtgacctgccgatcgtcgattcggtacagatccacgcggccagcaacagcggcaaagtgatctacacgccgtcgccgcggatgacccagatctataccggcaactacggcggtggcatcgatgccgggctgctgcacaaggccatgtatgaagtcgtgcagcccaacggcctgctggtgttccgcgatccggcgcgcaccacgggtgcctcggtcactttcgatcctgatggcagcggcagcaagctggagtcgttcccgggccaggacatctacagcaacagggtcatcaccgccaagggctaccgcgacccgggcgatacgttgaatgtcaccgccaacgtgagcggcgacatcaacccgggctacctgcgcaccggtcgccagctgcagaccttcgtcgatgatgacttcgcgcgctggaacaccaactggcagtccagctacatcaatctggcgcagagcatctacaacgcgtccagcaatggtccgcagggcatcggcgcgaactcggtacaggactaccagaacgatcccacatacaaggccctgctgctgtcgaagctgcgcctgggcgacctggatgtgtccacgctggacaactccatgggcgtgatccgcgtgaccaacggcgcgacatggcggacctccgcgaccaccggtgccgacttcatgctggtcgacaacggcaccatcgcgctggaaggcggcgccctgcgcgcttcggaggtgcgggtaatggccgcaggcatgctggtcggcaatggtgacgtggccggcaccgctatggatctcagtgcgttggccagcggtacccgcccgtcctggcgcgaggatggcttcaaccgcctgcgcgtgtacgggaccctgatgccgcgcggcggcgatctggtcacccatggctacgtcaacatcatgccgggcgggaaggtgctgttcgatgtgaccgaaaacggcggggcgggcagtggccgcctgcgtgtaggcagtttcttcgacagcaagcagaccgacggcgcgctggtgatctccaaaggggccttcctcgaactgaacgtggcgcagggttactacggccaggacttccgccgtgacctggtgcagggcccgatctaccagggcggcttcgaagaggtcgtgcgtctgggtgacaccggctacagcgccagcatcaccggcggcgaagtgttccgcccgcgccacaactcgctgctgagtttcaacgtgaagcaggccgctgacggcctgtggctgaccgccaacccgggtttcgaccagctgggcctgttcaccaaccgcacttccggcgatggcttgggccgcgcgctggcgactgcttccgatcgcagggatggtggcctgaagtcgctgctcggcgccctgcagttcgccgaccgtgatgtgatcgcacagcaggccggtgccctgcgcggtgacgcgcacgcgaccctgcgcctggccgacaacgcattggtgggcagcatcggcaacgtggtgcagcagcaccaggccgcgatgcgcagtggcggtgatgccgacggcctggcctcgcaggccgcgcaatcggtgtcggcgcagccgggcatgcgccacggcagcctgttcaaccagctggccatgcatctggtcgagccggcggcgggcggcggtgaaggcagtggccctggtcgcaaccatggcctgtgggcgcgcggtttcgccagccacggccgcatcgatgccgacggtggcgtggcaggcttgagccataacatcggcggcatcgtcgtcggcgccgatacccgcgttgccgatgaccgcgtcaccctgggcgtcagcgtggcagcggcggatatgtcgaccaagggccgcgacggctccgacttcagtggtgacgtgcgcgcgctggacgtgggcggctacctggacgcgacctattcgcgcggctatctctcggcggcggtgcgctacacagacctgcgtcacgacacccgccgcagcgtcagcggtatcgatggcctgcagcagccgctgcgtgccaagtacagcaacgatgcgatctccgcgcgggtggagcacgcgttctcattcaccacgggcaagggcctggtgatccagccgctgttgccggtggtggactacgcgcgtacctcggccacgcgcttcaatgaagggcagggcgcgggtgcactggtcggtcgcagcggcagcctggagagcatccgcgtgggcgccggcctgcagctgttcaggaccttcgaaggcaacaacggcgagcgcattaccccgcgtgcccgcgtggtctggcagaaggaactgggcgactcgcaggcgcgctacagcaccggcttcgccgccgctccggatctggtgttcggggcaagcagccaggccgtgggcgagcaggtgctggcctggaacctgggcgtgaccagccgcgccagcgaacgcctgtcgatcatggccgactacgtgggcgagcgtcgtgacgggcagatccagaacggcgtgatgctggggctgggttacaagttctga

SEQ ID NO: 10 - DNA, 3018 bp, Streptomyces Sp.
ttgtcccaccatcagttcctgcgtgcccgaagacttctcacctctctactgaccggggccgttctgaccggcggcctcctcgccgcaccgggatcctcggccgccacgaacgccgccgcggccatcccgacccaggagcccggggtcaccctgcgcgtgttcgacgtgcagacgccgctgagcaagctgtgcaccctcaagcccggccagacccccaaccacgacgcgctcaagtcgacggtggactggtcgacgaccgatgacttcggcggattctccgaccggttcgtgtcggaggtgaccggctacctggtcgtgccgagcgacggcacctacggcctgcggctcaccagcgacgacgggtcccggctgagcatcgacggcgacaccgtcatcgaccacgacggactccacggcgcggagccgaaggacacctccgtccagctcacggcgggctcgcaccccctgcgcatcgatcacttcgagcgggacggcggacaggagctgcggctggcgtggaagccgccgggcgcgagcgacttcacgaccgtgccgcgcgaggcgctgagcacggacgccggggtcgtacgggtcacggcacccggacgcaaggagtgcgaggcgagcggcgacacccccggcgacggcctcccgctcaccgacgtacgccccgacctcaagctcaccgatctgcgccccgacggtttcgaaccgcaggtcaccgggatggactggctgcccgacggacggctggcgatcagcacctggggcggctccgacaacgttgccggagaggtgtacctgctcgacaacgtgaccggtgacaccagcaaggacaaggtcaccgtcaagaaggtggcgagcgggctgcgggagcccatgggcatcaagtacgtggacggctcgctgtacgtctcgcagaagcacgaactgacccggctcgtcgacaagaaccgcgacgacgtggccgacgagtaccgcaccgtcgcgacgtggccgtacggcaagaacttccacgagttcgccttcggactcctctaccgcgacggctacttctacgtgaacctgtccgtctccatcaacctgggcggcgcgaccaccgttccgcagccggcgccgggccgcgggaccacgtacaaggtcagcaggaagaccgggaagatcagtccgatcgcgggcggactgcggacgccgaacgggatcggctggggtccgaagggcgagatcttcgcgacggacaaccagggcggctggctgccctcgtcgaaactcgtgcacgtcaagcagggccgcttcttcaaccactacaccgagccgtccggcgccttcgacgcggccactccgaccgcgccggtgctgtggctgccgcagaacgagatcgccaactcgccctccacaccgctgtatgtgaagaagggccagttcaagggccagatgctgatcggtgacgtgacctacggcggtctgcagcgcgcgtacctggagaaggtgaagggccagtaccagggcgccgtgttccgctacacacagggcctcgaagcgggtgtgaaccgcctcagttacggtcccgacggttcgatctacgccggtggtctgggcgcggacggcaactggggtcaggaagggaagctcaagttcggcctgcagaagctcacgcccaacggcggcaacaccttcgacgtcaagacgatgcgtgccgtacccggcggcttcgacctgacctacacccagccggtgtcggcgaagacggccgaggaactggccaagcactacaaggccgagcagtggcggtacaccccgaccagcgactacggcggcccgaagatcgccgaagaggtgcttcccgtccggtcggccgagctgtccaaggacaagcgcaccgtgaagctgcggctcgacgacctgaagcccggccgggtcgtgcacctgcgctccccgcgccccttcacctccgagtcaggtgagtcgctgtggaacaccgaggcctggtacacgctcaacgccatgcccggcaagcagccgcccgccgccaccctgtacgaggccgaggaggcccggctcaccggcacggccggcatcgccacggaccaccccggctactccggcagcgggttcgtcgcgcggtacaacacggagggcaaggtcgccacgaccttcgacgtgcaggtcaagaagtcgggcacgtacgacgtcaacctgcgctattccaacggccccaacccgttccaggggaccaagtcgctctccctgtacgccaacgggaagaagctgcggcaggtgaagctcgcctccaccagtgactggaactcctggtccacgcagaccgaacaggtggagctgcgcaagggcgacaacaccatctcctaccgcttcgaggccggggacaccggccatgtcaacctcgacctgatcaccgtccggcccaagggcgcgtccctcgccctcttcgacgggaccgcggcctcgcagtcgcagtggcagcacacggacggccgacggctggagtggccgctcgccgacgaggggtccatggaggtgtgctgcggtgacatccggaccatcgacgcgtaccaggacttcaagctgcacgccgagttccgggttccgctgctgcccgacgacgtcaccgggcagaaccgcgggaacagcggaatcttcatccaggaccgctacgagctgcagatcctcgactcctacggcgacaccaccctggacaccaacgaggccggggccatctatctgaagaaggcgcccgacgtcaacgcggccaaggctcccgagacctggcagacgtacgacatcgtgttccgtgccgcccgctacgacgacagcggcaagaagaccgcggacgcccggctgaccgtggtgtggaacggccagaaggtccacgacgacatcaccctcgacagccccaccgcctcgggccgggccgagacgccgtcgacgggggcgatccggctgcaggaccacgggaacaaggtccggttccgcaacatcacactggagccgctcacatga

SEQ ID NO: 11 - DNA, 2055 bp, Streptomyces Sp.
gtgataactcgtacccggctgaccgcgctggccgcgacggccgccctcgccgccaccggcggcctgatcaccgccgccccggcctccgcggccgtcacctgcacctctcccgtctggagggtgcagtacttcggcaactccaccttcagcggcacgccgaagctgaccgcctgcgactccgccatcagcgagaactacgggtacggcgacccgaccggcgtcacgctgcccaaggacaacttctccgtccgctggtccctcacccgggacttcggttccggtggccccttccggctctccgccgccacgcaggacggcatgcgcgtctacgtcgacggtgtgcggaagatcgacctgtggaaggacgtctccaccaccgcccgcaagggcgtcgacctgaccgtcccggccggcaagcacacgatccgcgtggaccacgttgcctggaccggcctcgtctacgccgggttcacgtacgccccgcgcaccgcggccgccgtcgacacggtcaagccgctcgccccgaccggcctcaccgccgcgtacaaccgggacaccacgaagaccaccctgcgctgggccgcgaacaaggagatggacctcgccggctaccgcgtgtaccgccggctgagcaccacccagtgggcgaaggccagcggctcgtcgctgctcaactccccgtccttcgtggacgcgacgcctgccacgggccagagcttcctgtacgaggtccgcgccgtcgacaaggcgggccgcgagtccgccggcagcctcgacgccatcgctgcgaccgtggaccgcacgggcccggcggcgccgaccggtctcacggtcgccagcgacgcgtggtgggccaccctggcctggcaggcgggcgccgacgccgcgaggtacgaggtgtacgccgcctccgctgccgccggcccgttcgagctgctgggcacgacgaccacgacgtcgtaccgcaccgacgcctccgtgaacaccgcccggtactaccgggtccgcgccctggacgcgctcggcaacccgtcggcgtacgccgccgtcaccggcgacggcgtcgaccggacgccgccgaagtccccgacctccctcggctccgtcgtccgcgtcggcgacaccgaggtgtactggaagcagcccgacggcttctacgaggacttcgacaacggcgggacctaccgcgtctaccgctcgcccggcaagaccctcgacctggccgcactcacccgcgtgacctgcgccgaggagagcgacgagaccagcaccggcggtatctgccacgacttggacgtgcccgcgggcacgtacgtgtcgtacgcggtcgtggcggtggacccggccggcaacgagtcggcgccgtccgcgccgctcgtcgtccgcaccggcgaccgcgtcgcgcccggcccggtcgccggcgtgaaggccaccccgcgcaccgacggcgtactaatgagctgggccgcctcgaccgaggacgacgtcgagcgctatgtggcctggaccggcgcccggcaggccgacggcacggtcaagtggctcagctccacctcctgcgcggagggcacgagcgacccgctcgcggtcctctgtggcgacctgccggacggcgagacgtacgtgtacgcagtcgtcgccaaggaccgctgggacaacgcgctgcccccgaacgactcgaaggtcacggtcgtcgaggccaccgagccggacgtccggccgtccgtgacggtcacccgggactgggacctcggcagcatgggctacgacaccataatcggcggacccgacctggacgggccgtacatcaactggcggtgcgacaagacggctgagtgcgacaccgtcaccggttaccgggtcagccggtggaacgcggccacgaaagcgtacgagccgctgcacgccggactgctggcggcggagactcgtgcctacacggacaccacggccgcgcgggggaccacgcacttctacatgctggaggcggtgcgcgcggacggcagcgtcgtgggcacgcacgtgtggagctgcgtcttccaggaccgcgtctag

SEQ ID NO: 12 - DNA, 300 bp, Streptomyces Sp.
gtgaacacgaccagcggtgcgcagaccgtcatggtcaccaactcccgcaccaccaccgccccgatcgccggggtgaccaccctgaccggcaaccagtccgacaaccccaccacggtggctctgtcggacaccggcaccacccagaccgacctcgccgccggcaagcccaccagcgagtccagcaacaccgtcacgctcaccttccccgccgccaccgagcactacttccacgccctcatcaccgccgacagcggccggcccgcgggccaggtgtccgagttccatatctggagctcctga

SEQ ID NO: 13 - DNA, 1899 bp, Streptomyces Sp.
atgggtcactcccccaggaccggacgcgcgaggtacgcggcgctcaccggaatagcgtcgctcgcgctcgccttcgccggcttggccggcgcggccggtccggcctccgcgcaggacatctccggctcgcagggcagcaccaccaacgagttcaacccctggagcccgcagaacggtcacccctaccggcacggcgcggtccccggcatgtcccagcacgagaactacaagaagtggctcgccgcccacaaccaggccgcggcgaccggtcagcagacgctgtcgtacggcggcggcgtcgacgggatcggcgtgcagagtgggcactccaaggtctacctggtcttctacggcaaccagtggggcacccagaccaccgacgccggcggcaacgcgaagttctccaacgactcggccggtgccgccggtgccacccagcagatgttcaagggcatcggcaccaacggcgagacctggtcggccgacctcacccagtggtgcgacggccccaacgtcgccaccggtgccgtgagctgcccgtcgaacgccaacttcatcccgtaccagagcggcggcgtcctgtccggcgtctggtacgacaacgcggccgcctcgccgagccaggccagcggcaaccagctcgcccaggaggccgtcaaggccgccggacacttcggcaacaccaccgccgcagccaaccgggacgcgtactacatcgtcctgtcgccgcacggcaccaacccggacgactaccagaacccgaccaccgggtactgcgcctggcacgactggaacggtgacaccaccctcaccggcggtgcggcgagctcgccctacggcgacatcgccttctccaaccagccgtacaacatcgacgcgggctccaactgcggcgtcggcttcgtcaactcgcccggcacgctggacggctggacgatgaccctcggccacgagtggcacgagatgatgtccgaccagaacccggccggaggctggaccaaccacgtctccggcagcagctacaacggccaggagaactccgacgagtgcgcctggatccagcccggcagcaccggcggcgccgccaacatctccttcggggcattcggcagctacgccgagcaggccagctggtccaacgacaccaactcctgcgcgatctcgcacgccatcctgacccacggcaacgcggtcaccgtcaccagcccgggcaaccagagcggcaccgtcggcaccgcggtcagcctgcagatcaacgccaccgactcggccaccggccagacgctgggctactcggccaccggcctgccggccggcctgtcgatcaacgcctcgaccggcctgatctccggcaccccgaccgccgccggcacctccagcgtcacggtcaccgccaccgacaccaccggcgccgccggcagcaccaccttcacctggaccgagtccaccggcgggggcggcggcaacgccatcaccaacggcggactggagaccggcagcctgaccggctggaccaccgtcggcagcacctccgccaccgcccccgccgcccacagcggcggctacggcgccatggtcggctccaccggcccgaccggggactcctcgatcgcccagaccttcaccgcgccgaccggcaccagcaagctgtccttctggtacagcaacacctgtgacgacaccgtcacctacgactgggccaccgccaccctgaaggacaacaccaccggcacgacgaccacggtcctggccaagacctgcaccaccaccggtacctggaccaacaagacggcgaccgtcaccccgggccactcctacaccctcaccctgagcaaccacgacgacaactacccgggtgacccgacctacacctactacgacgacgtgaccgtctcctga

SEQ ID NO: 14 - DNA, 2490 bp, Streptomyces Sp.
gtgtcacccagacacacccgatgggcccgagccctcaccgccgccaccaccctggcggcgctcggcgccggcaccctggccgccgccccggcgcccgccgacgcaccggccgccggccaaccggcccccgccacgtacacggtcgcggtcggccggaccggctcgtacgcctaccccgacgacacccaggccagtccctacaccgacaaggacggcaccttctacttccagcagtcccacgcgctgtacggcgccaaggactcccggcagtgggacttcttcaccggccgggacttcgacagcgccaccaggtcgtccgcgatcagcgacgccgtcaaccccgccgacccgtccgaccgcaacgacgacaccaccgcacgctgcaacaacagccccaccggacggcagtccagctacgcgccgcagggttcgcactacgcccagcggaactactgcgacctggccggggtctgggtcgacccggacagcggggcctggtacgggctggtgcacaacgagttcaccccccagcccttcggcgacggcctgcactacgacgcgatcgactacgccgtctccaccgaccagggccggacctggaccatcagggaccacgtgatcacctcgccgtacagcaccgcacgcggtgacaccgcggccttcccgcagcagaccttctcctacggcgacggcgaccagcggctgttcgctgacaccgcctccgggtacttctacgtcttctacggctcccggatcgtcgacaagggcggcagctggggcgccttccagcagcacgtcgcgcgggccccgatgtccgccaagatggcgccgggaagctggcagaagtggtacgacggcgcgtggtcgcagcccggggcgggaggcctggagagcgacatggtgcccgccgacggcgccaaccccaccggatacctcccgccggccaaggagtacaaccccgccaaccccggcaccgtcagccggcagatcgcggccggcacgctcgcgccgagcacaccgctgttcgtcatgaacatcagctacgacgcctatctgggtctctacatcggcactccgcaggccgtcgaccagagcggcaacgccccgcagcagatctacgccaccaaggacctggccacccagaagtggaccctgctcggcgacaccggcggttaccacaccgcctcctggtaccgctggttcctggacagcgccagcctgaccggctccacgatcgtcggcaagaccttcaggtcgtactgctccttcgcctgcgccggctccgacggccagtacgtcgagctgaccgtcggctcctccgcgccggccgccccgccggtcgacctgaccaggacctaccggatccagaacggcaacggccgggtcctcgcccagacggccggcggctccgccgtcacctccacggccaaggcggccggctccgcccgcgagtcctggcggttcctggccgagggcgacggctcctaccggatcgtcaacgccgccaccggtcagctgctgggcgtcgacgccacctcgacggcgggccgggcctggggcgccgcgctgaccgccaccggcgccgtcggcggtgacgccaccgtcgggcagcagtggttcatcctccccagcaaggccgggaagggccggttccagctggtgaaccgttacagcggcctggtgatcggcatgtccggcacctccggccggctcgccgagaccgcgcccgcccgctcctggagcgacaccaccggcggcacggtcggcggcggccgaacggcggccgagcaggccctcgccctcgccccgaccggcacggcccccgaggccgtcgtcctcaccgcccccggcgaccggtccggcaccgtgggcaaggccgcctcggtccagctcggcgccaccgacagtgccggcaagccgctcaccttcacggcgaccgggctgcccgccggactctccgtcagcccctcgggcctgatcaccggcaccccgaccgggcccggagtctcgaaggtcaccgtcaccgcctcctccggcaccgcgagcggctcggccgacttcacctggacggtcgagccggacctcggcggcaaccacaccctgaccacgggcggcaaggccctcgacgacgccgaccacagcaccgccgccggcaaccccctcatcacctggaccgcctccggcgggagcaaccaggtctggcagttccgcccccaacccgacggctcgtacgagctggtcaacggcctctcgtcgatgtgcgccgacgtcagcggcggctccaccgacgccggcgcccaggtgatccagtggccgtgcagcggcggcgccaaccagcactggaacgtccggctgacggccgacggctcgtacagcgtcacctcggcccacagcggcctgctgctcaccaccgcctccggcgccgacggcgcacgggtgacgcaggaaccggacaccggatcgccgctgcagcggtggtcgatctcctga

SEQ ID NO: 15 - DNA, 2487 bp, Streptomyces Sp.
atgccgccccgcccccgcgccttacccaccggtctcgccctcctggccgtcctcaccgcccaggccctctgcgccgccccggccccggccgccgccggagcaccgctcgtcgacggcggcagctaccagctcggctccgcgctggacggctcctgcctcggcccccagtacgcccagcccgcccccggcaccccggtgctcggcgcggcctgcggacgcctgctcagccagcgctggcagctgcgccgcaccggcggcgactacctcctggtcaacgccgccagcggccgctgcctcaccctcggcggtccggacctccgccccgccaccgccgactgcggctccgcccccgaggccgagcgcttcacggtctcccgtgctccgcagggcacctacaccctcaccgtccgcggcaccggcgcctgcctgaccgccgacccggccccggtgaaccaccactgcgaccaccgccccgcccaccgctggacgctcacccgcaccgagccgctggtcctcgccgaccccggcttcgagcagagcagcgggagcggcgcccccaccaccggcgcccccaccaccggcgcccccaccaccggcgcccccgccgccgacagctcgtccgccgccgacagctcgtccgccaccggcggcccgtccaccgccgccggctggaccttcaccgcccacaccggcaccgccaccaacaacccgcacggcggcagccgcctcgcctacctcgacgccggccccggttacacggtgagccagcaggtcaccgccgtcaccgcgggcacctacgacctgtccgcctggatcgcgacgggcggcgccggcggcagcctctcggtgagcgtcaacggcaccgtggtgcgctccctgccgctgcccgagcagtccacctacgcgaagtacaccctcccccgggtgcgggtcgccgccggcgaccggctcaccctcaccatcggctcctccccgacgggctgggtcaacgtggacgacgccgccgtcgccccgtccgcccccaacgacccggtgatcagctcctccgaccccgaggtcgtcgccctcttcgactgggccaagaccaaggccaacagctgggtgcagcagcccggcgccaccggtgtgctcgaccaggacgagaaccaccccggcggcaccggcaccaccacctacgacgcctcctactgggccggctacccgttccgctccgccttctacagccgtgacttcgcccaccagctggtcggcgcccacctgctcgggctggacgccgagaacaagaccatgctgcgcggcttcgcggcctccgccaccgacgtcaaccggctctacccggtctgggcgctcaacttcgacgcccgcagctacgcggccatcgactaccgcggcccggaccgcttcgtccgcgagctgcccgcgccgttcgaactcgtccagcaggccggcgaggccttccgctggaccggcgaccgggactacgccgaggacccgggcctgggccgctacgtccgcaacaccctcggcccgttcatcgccgcccgccccggcccggtcgacaacggcggggtgccgatcccgcaggccaccagccgcagcatcttcgccggcaccgccagctacgccgagaacgccacccgcacctacgccgaggcgggcgacgcggtcggcgcccagtaccaggcctacctcgccgccgcgacgctggccgaggcccggggcgacgccgcctccgccgccggctaccggaaggccgccgaccagctgcacacgtacgtcaacaccacctggagcgtggacggttcgcggcccggcgaggtcgtccacggctacgacaccaccggcaagccgatcaccggctggggctacgaggcgagcgtactgatgccggtcaagcggctgctcgacccgggcccgcgccgggacggcttcctcgccgccgtcgacgccgccgactccggcccggagcgctcggccaacctggaggcctacacctacctcccggacgccttcttcgccaaccacgacggcaccaccgcctggaagtggatgcggcacatctacgagagcaccggcgagccgcacgtgagcggcgcgatgctcaacggcgactaccccgaggtcccgttcaccctgctcgcccagaccgtccagggcctgctcggtgtcaccccggacgccgccggccacgcgctcaccaccgccccgcaactgccctcctcgatgggctggctccaggtcgcgggcatcccggtgggcgccggcacggtgaccgtccgccacgacggcgcacagcgcagcaccgtcaccaacaccggtaccgagcggctgacctgggaggcccgcttccccgggcagcacgcccgcgtcaccgtcgacggcgcgccgcgcgaggcccgcaccacgaccgtcgacggcgtgacctacacctccaccaccgtgaccctcgcccccggccgctccgcgaccgcgaccgtcaccgactga

SEQ ID NO: 16 - DNA, 1278 bp, Streptomyces Sp.
atgcgccccacaagatccgtcagccgcacaggcagagcgctcatggcctgtactgcctcggccgctgtagccaccgtgggccttgccgtctcaccggccgcggccgtacccgccaagtccgctgccaccacgcaggtcgagcccggcggcgcctgcacggcggccgacctcggcacacgccacccgtacatcaagacgaccgaagtcaccccgacgatcacccacttcaagggctggtacgtcaccgagggcacaaccggctctcagaccatcaccaccagcacccagaccaccatctcggtctccgtcggcctcaacggcaccgtccagggcagcttcgccgtcgagaccctcggcaccgtcggcgcgagcctgggcctgaacgttcaggtcacctactcctccaccagcagcgagtcgaattcggtcacgtggaatttcaaccggcccggctactacggcgtctacaagggcaccaagaaggtcaccggtacgtacggaagcctcaactgcaaccgcgtccaacagggcgacgccagttgggcgttgaagtggaccgagggggccggcagcggcagcttcaccacctacaccgcccttgaggaaggcgcggtgcgctgcgaggacgaggtgcccgccaacagcatcatggccacggcacaaggcctcctggactgcggctcggccgccgcgaaggccgagcacccggcgggtgcggtggcgccggcggcgaagcagctgcgggaccggctcgtgcagcgcccggctctcaccgtcggaacgtccgccgaacagcccaaagccaccgggcgtagtgcgcggtccgctctcaactgcgggaccgacgcctacaagatcgctgtacccggcaagcccctgtcctggggcgcgccgctcctggcggacgacggtgtccgcctgcggccctcgacgatcttcagcgcccacctggacaactggcggctgtgcgacgtgacggagaacaacggggtcctcgaggcgtccctgtggaactggggcaacggcaggtgcgcggccatcgccgagcagaacgcggccaccgaaggggcggtcctgatgacggccccctgcacggaggacgacctccagcggttctacatctaccgcgacgtacccggcagctcgatgatcggtgtgcagaacaagtacaccggctccatgatgggccacgaccgttacgcggacggggagttcatccgccagtactccagcggcagacaggacggtacgggcacctacaccctgaccggagtctga

SEQ ID NO: 17 - DNA, 2232 bp, Streptomyces Sp.
atgaaacgactattcagcaccgcacgccatatcgccgtaccgcggacgcgagtccgtctcgtcggcgcgaccctgatggcgctgctgctcgtcggcatcggactgggggtcgccccgttactccagggcgcccgggcggccggccccgccacggtcccggagcaggaaagcatcgaggcccagatcgcccgtgccgccgcctcagggaagaagcaggtcgacatcgagcccggtgagtaccgccgcggttccgttctcgacctcagcgggctcgacgggttcacgatcaacgccaagggcgtgacggtcgttcagacccggctcgtccaggccgtacggacgggtacgtcgaacaacctcaccgtcacaggtctcacgatcaactatgaccccctgccgttcacccaagggcgcgtcataggactcggcaagacgtccgacggcaaaccatggatggatgtgcggatcgacgccggttacccccgcccggacaaaattcccagtcgcgtgtcggtctacgaccccgctctccggctctggcggagccaggcgtacaacattcccgtcacctggcaggaccggaccgccggcgtggtccggtccatgggcggcgcatgggcggccggcaccggcgacatcgtcgcgttcgcgggcgaggccgaatcaggtcccgacatcgccatcggggtgggcggggcgaacaacacgttcaaggacgtgacactccacaccgctccgggattcggcttccagaacagggccggtgagggcaatacacacctggacaacttccgggtcgttccaggcccgccgcctccaggaggaaccgagaagcccatcctgaccacgacgtgggacgccatgggattcgggtgggtcaagaaggggcccacggtcgagaactccacggtcgtcggtgccggggacgactcgatgagcgtccagggcttcggcaccgccaaggtcctcaaggccgacggagacaccctctgggccgccttcgccgacggattccgcaacgcccttccgggtgaccgtctacagcagtggaccgacgggcccaccgcctccatccggtccatcgctccggagaaggaccccgccatcaaggccctggccggcgcgaaggccgacttcacctacaagctgacactcgaccgcccctcgccgtggaacgcgggcaccgacatcaccaacctcgaccgcatcggcagcggcttcgtcttccgcaacaaccgcatcgacagctccggtcgcgggttcctggtcaaggcgcgggacggcgtcatcgagaacaactggatgcgcggcgtcaactcgatctcggtgacacccgagaacacctcggacgccaacgccaacagcggcggaaacctcgtcatcagggggaacacctttaccggcacactggtgtcggcccccggaggctgggactcctgccaggtcggcgccgtctccttcgaccccggaagcgccagcaggcccctctaccccgacatcaccatcgaggacaatgtcttccaggacatcaggggcaccgggctcaatctcggctcggcgaagaacgtgaccgtgcggaacaacttcttccagcggtcccaccaggccacgtacccggcgacgaagaaccggtgcggtattccgaagtcatccgtcgtgtacgtgagcaactccaccggcgtgacgttcgagggcaacacgatcgaccgcatcggcccctactcggtacagcaggtgacagtcgacgacaggaaaccctccggtatcagcggtctgcccggcggagtgaaggtcctcaatccgtacctgcccgtcaaggccgcgagcacctacacgatctcgaaccgtgacagccgtctgctgctggccccggcaggcggttcgacggacgccggagccggtgtggagcagcagtccgccgcagacggcagcgcgcagcggtggcgcctttcgcccgccggaaacaacaacaccgtacggatccagaacgccgtgtcggggctgttcctgaccggtggatccgactcggccgtgacgcagcagccacgctccgacgaccagagccagcggtggcggctgctcgacaccgggaacggcacggcgaagatctcgaacgtcgcgaccggcaaggtgctgggcgccacggattccgccccgggtgctcccgccgggcagtggccggtgtccggggcactggaccaggcctggaagttcacggacgtgtcgccgtag

SEQ ID NO: 18 - DNA, 990 bp, Streptomyces Sp.
atggactacgacccgaagaagaagggctggtacgtctacggccacggccaggtgtcggcggacgggaagcaggtggtgccggacgcgaagacccgcgtatgggccttccacggcgcgatgttcaacaccggcgacatcctgccctgggacatgggctggctccaggacgtcatcgactggctgtccggtgacccggtcgagctgaccaccggaatgctcaccgactcccgtacggatctggcggtcggcggcaccctcggctccgccgagatcacccgtacctactggcagggcgatccggagaagcgggccttcggcatcggccgtgacctgtcgtacaacgccttcctgcactccaagaagcagtggcaggaagtggatctgtatctgccgggcggcagcaagacccacttcacgcgcacgtcgacgggcaccgactggaccaacgccgtcttcgaaccgctcgacagcccctcggggttccgcggatcgaagctggtgtggaaggggtacgacggtggctgggatctgaccttccgcgacggctcggtgtgggtgttcccgcagtacgcgccgctgaaggagatccgggaccggcacggcaacgccgtgaagatcacgcggctcgacggcaagcggggcgacatcacccggatcagcgcgcccggcggccggtggatctcgctggcgtacgacgcccagcaccgcgttacggggacgaaggacaacgcgggccgcaccacggcgtacacctacgacaccgcgggacgcctggacacggtgaccgaccccgcgggcaaggtcagccgctatacgtacgacggcaccacgaaccggatcaggaccgccgtcgacgcttgtggcatcacgtacatgtccaacaccttcgacgcggccggcgggtcaaggaacagacgctcaccgagggtgcgaagtacgccttcgagtacacccagaccggcgcgggcaagatcacctcggcgaccgtga

SEQ ID NO: 19 - DNA, 3951 bp, Streptomyces Sp.
gtgcgtctgcacggcgagcgtttcggggtccatctgtccacgcgctggcggtcgctgaccgtgggggcgctggtgctggcgctgtcggccggcctggtgtcggccgaggcggcgccgtcgcccacgtccggcgcgtcgtcatcaacaccgtcttcaggaccaccttcggcaccaccttcggcaccacctcaggcaccgccttccgaggcgaagcgggcggccgagcgggcggccgagccggcgggcccggagcagacccccgcggcagccgccgccgcggccgctccggcggtcagcgacgccgtatacgcgtacgacgcggccggccgcctcgtcggcagcacggacccggcgggcgagacggcccgctaccgctacgacgaggccggcaaccggctgggcatcgaccggttcgcgtccgccgatctgtcggttctgtcgctggtgccgacccgggccgccgtcggggcgaccgtcaccctttcgggaacgggcttctccacgacgccgagctcgaacgcggtctcgttcggcgggcagacggccgaggtggtgtccgcgtccgcgacgcggctgaaggtcaaggtccccgcggcggccgtcgccgggaaggtgtcggtgacaacgggcggcggcacggcccagtcgccggaatcgttcacgctcgccgcgcccgcgccttcggtcacgaaggtggacccgacgtccggttacgcgggtaccgcagtggtgctctcgggggccgggttcgccgccgccaccgccgacaacgtggtgagattcggcggcggagtcgtggccgagatcgtcgagcggaccgacacggccctgaaggtgctggtgccggccggcgccgccaccggaccggttgaggtggccaccccggacggccggaccacctccgccgccgctttccggctggtcgccggtgacggcggaggcgagatcgagacctcggtggagacgtccgtgacggacgagaccccaccgacggtctccgtgaccaccccgggcaaccaggcgcaggtggtcttcgacgccaacgcgggcgatgacatcagcatcggtttcaccgagtcgaccttcaaccagaccgtcaccgtccggctgctcgacccgcagggaaagcgcctggagtccgccgcgtacaccggcacggccggcgactgggagatgacggacgtaccggtgagtggccagtactcggtgatcgtcgaccccggcacgggcaatatcggctcggtcaaggtgaccgtgtccaacccccggatctcggcgctcgacctcgcgggaccggcggtcgacgcgcagttcacccggcccggacaggaccatctgctcacgttcgcggccctgttgggcgactcgctcagccttggtatcgacgcgaccggcctggccaagtcgacctacgcacggctgtacggccccgacggcgccgagatcgacaaggtgtacgtcacggggacgcggatcggcggccttgacgtggacgccctgacccagtccggcacgtacacccttcagctcgacccggacgccgccgcgctgggcaccgtcaaggtcaccggttcgcactatgccgacgcgggcacgctcaccgcgaccggtcccgcgcttgacgtatcactgatccggcaggggcagcagggccgcgcccagttctccgcgcaggccggccagcgggtgtcgctcggtggctcggcgaccggtttcggcaacttcacccgagttgagatccaccagccggacggcgccctgctcgactacttcctcgtcccggacgccgacgcgggccagtgggacagcgccacgctcaccacgtcgggcacgtacaccgtcgtcgtgaaaccgggcagcccgctcgccaccggcaagatgacactgaccctgtcgcgcccgctcgccctcgcggctctcaccaccactgccagtgcgtcggcggtgaacatcacccggccggggcagaacgccgaatcatccttccaggcgcaggcgggcgcggatctctcgctcggcttcaccgccaacaccttcccgcagtacatcgatgtgacggtgaccgcgccgtccggtgcgaaggtcgtcgacggggtgaacgtcaccgcgggcgcggccacgacgatcccgctgcccgtgttgacagaagcgggtacgtaccaggtggtcctcgacccgaacaagggcgccgtaggggcgacttcactgaccctctccgctgtcgcgagggccacgctcaccgccgacggagcccaacagccgacgacggtcgcccgcgcgggccagcgggtgcgggccacgttcaccgccccggacaccgctgccctggggctcgccgtcaccgcgaacaccatcgcggagtccaccgagatcagactgatcggacccgacggcggtgcgggcgcgctcgccggacgcgtcgcgagcaaggcgtccgacaccttctatctgaccggcctcacctcgggaaccgcgtaccagctggtgttcgagccggccaaggccacgaccggagccatgaccctgtggctgtccaagccggtcaaggccggcacactctcgaccaccgcaccgacgctcacgggtgagatcacccggccgggcgcgcaactcgaattcggcgtcaacgcggtgacgggctacggcgccgcggtcgtcttcagcggcacgacgctcaccgagacatccgcgctcatccaccagacccctggtggtgtggaggacaacgtcggttcgctgagcaaggcgaccctggacgccgatctgcgggcgcccctggcggtcggcggccaccgggtgttcgtacgccccaacggctcggccaccggaaagaccacggccacactggtccccaacgtgaccggcggcgccctggccaccaccggcacgaagaagtccgtcgcgatcgccacggcgggccagaacgcccactacaccttcaccggtaccgcggggcagaagctcacgctcggtctggacacaccgccgggtgcctggtcgctgtcggtccacggcccggacgggaagtggctggtcgacggccggaacatgagcgcgacgacggtgagctacgccctgccggcgctcccggccaacggcacgtacacgctgtcggtcgaccccaactcgctcaagaccggtacctggaacctcggactgaccgccgcggccaccctccgagcggccacggcggctgacacggcggacgggcctgacacggcggaaggggccgacaaggcggccggggctgatgagccggcgactccgaagccgccggccgccggtgtcaccccgaccggcgcggacgcctggcagccggacaaggggaatctctccggccacgactggctcacccgccgcggcgacgcccccaaggccccgcccacgctgcgcgccccgccgaagaccacggcgctgaccgggcatgtgctcaagctcgacggcaagccgctggccggggtcaccgtctccgcgggcgcgaacaccgcgcggaccgacgcggagggcaggttcctgctggccgggatcagcccggaagcgaccaccctggtggtggacggcgcgagcgccaacacgaagcagcggcagtacggcaggttcgacatccggatccgtcccaaggcggacacctcggtcgacctcggcttcccggtgtggatgacgccgctggacatgaagaacaccgtgcgcttcgcggcccccgcgaagaccgacgtcgtactgaagacgccgaagatcccgggccttgaggtacgcatccccaagggctcggtggtacgggacgagaagggccggccggtcaccgagctggggatcacagcgatcccgatcgaccgtccgccgttcccgctgcccgagaacggcgtcgtgccggtcttcttcaccgtgcagcccggcggtacgtacgtcttccccgagggcgcggatcgtctacccgaactacacgcgtga

SEQ ID NO: 20 - DNA, 2202 bp, Streptomyces Sp.
atggactcagttggcagagtggtgcggcgcgggacgacgctgggagcgttatcggtcgtgctcggggttctgacgaccggtaccgcgaccgcggggaccgccacggcggagaccgccaccgccgggcaggactccggcgccctgtcggcgcgggtcgcgccgacgcaggaggacatccaactgggctcgtggatgtcccagctcggcagcaccatcggcgaccgtcccctgaaccagatcgtgatgccgggcagccatgacgccggcagcgcgggcatcacgaagaacagcggcatgtgcgatgccggtgacacggtcgacaccgcgcggaagtggcccgaactggcctccagcatgtcgcgcacgcagagcggctctctcgtggagcagctcgaagccggatcccgctacctggacctgcgcctgtgcaagcagggcgacaagtggtacagctaccacggcggcccgctggggcggcagttcttcgactcgctcggcgggaaccaggggatcgtcccgggagaggcgcgcgagctggccgactggatcaaccggcaccccaaggagatcgtcattctccgggtgaagaccaccggcccggcggcgaccctcaaggaggacagccgcgcggccatcgccaggctgggcggcctggtgggcggcggcgggctggacaacccggcgatcgcggacggttcgctgaagcccacgtccacgtacaacgagttcatggccgcgggcaagcatgtggtcgtcgtcgacgacacggacagcacgacgtacccgtgggcctggcagcagccgaacgtacaggactaccggggcagttacgtcggggtcagttccaagtgggacgacatcctcaaggcggcgctggacccggcgctggaacagaagacgtacgacgcggtgctcaggcgcggtgacgaggtgctgggcaagacacccgagccggggagcgagaagaagctcttcgtccagcaggccatgatcgatccctccaactccatacccagcgccgccgtcatccagatcctggagaagctcaagctcgtgtcggagtggaaggccgacaacttcctgatcagcatggagaacgagctgaacagacaactgctggcgaaactgcgcacgtcctggaacaacaccaacgtcaccgacaacatgaacatcgtcatgacggacgacgtgaaccagaaccgcaacggggtggccgccggggaactccagcgggagatcatctccaagaacctcccgcagcggatcacctcgcacacgttctacaactcgacacgcaaggccgacggtacgtggaccgggccgagcgcgctgagcggagcgggcacggcgttccgctacgtcggggaccggcaggccgtgggcgcgacgcgtgacggtggcgttcaggtgctcggcgtcggggcggacggcaacatctggcacaacctccgtcgccccgacggcagttggcagggctggaacgccctcctggccgcggacaacaagaacgtcggcttcgccgccaaggacatcgccctcacgaccatgcccaacggcgacgcccaggtcgtggccgtgggcaaggacgggtacgcgtaccacaacatccgctccgccgacggcggctggcagggctgggcctccatgcccggccatgacgcgggcctgctgaaggcgaccaaggtcgccgcggccggcatgcccgacggctccacgcaggtgctggtcttcggcggcgacggcaggatgcgcctgggcacccgggccgccgacggcgcctggagctcctggaagaccgtcgcgggcgtcaacgcgccggacttcgccggatcggcgctgtcgatcgcggccctgcccaacggcgacagccagatcgcggcgatcggcaacgacggcaacgtctggcacaccacccaccgtgccgacggcagttggtcggactggggcctccccgccggggtgtcgggcggcgcgatggaggcctccgcggtctccctcgccgggatgcccggcggttccgtccaggtggccgccgtcggacgtgacggcaatgtctaccacggcgttcgctcctccggtggcgactggaccccgttccagcgcgtgagcggcatcaagggggccggggcgttcgcgggcgaccaggtcggcatcgccggcctgcccaacggctccagccagctcatcctcaccacccgctga

SEQ ID NO: 21 - DNA, 4719 bp, Streptomyces Sp.
atgccacgccacaaggctctcctcatcggagccagcgagtacgacgacgagacgatccgctcgctgcccttcgtccgcgacgacctccaacggctggagggcgtcctctccgaccggggattccggccggtggagatcgccgagtcccagcgcggcatcaccccgaacgccgtcaatcgccacgtcctgcgcttcctgcgcgaggccggccgcggcgacaccctgttcatcatgctcagcggccacggggtgcacttcgacggccgggactatctcgtgccggaggacgcctactacgagagcgagccgttcgccgagagctgcgtcgagatcggctggcagaaggagctggaggattcccccgccggccaggtggtcttcctcatcgacgcctgccgcgaggggtccgcccgcaggaccaagtcccccaccaggatgcccggttgggaacgccccaagatcgccgcgacgctgcgccgcaagatcgcgtacgtatacgcgtgctccaaggcccagtacgcgctgtacgtggacgagtccgaggccgtactcccccagcacgccgacgccgccggcacccagccgaaggactcgttcagtctcttctcccgcgccgtctcggacgtcgtgtcggccgtgccgcacaccctgcacatgggcgagttcctggacgaggtgcagcgccggttgaccgccctgcacaccgcgtacggcaagacgcagccggtccagcgggtcagggccgagaccgacatcccctggcaggagttcacggtcctgccgggccccgcccgggacgccgccgaacatccctgggtacgcagcaccgccacccaccccgcatgggaacggaccacccccggcgccgcccgcgaggcgctcaaggacgtctgcgccaccctcgccgcccggctcgccgaggggtacgagacggcggcggccacgctgcgggacgacccgtggcacgacgccgagctggccaagcgcgcccaggaccggctcggctttctcaccgggcggctggcggccggtgcggaactctccccgaccgaaggcgcgttgacggtcctgctgccgctgctcggccaggcgttctggacgcacgaagcggcccagcgggcgccggtggtcaccgcgggcccggccgaccagcccacccccgagcgcgaccgcttcggcaagttcgcccaggggttcccccgcctccagcgccggctgcgcaccctggagcagcgcggcgtctcggacggatcggccgaacgcatccgctggtggctgttccaccgctggctcatccggcagcccgagctgtacgcgtcccagaccctgaagacgctgctcgggccgccgcccggcggcacgcagtgcccggagtgggtgacggaagccctgtccggggagcggttcatgcgcttcctccaggagctgcgggcggcgccgttcgccgtaccccgcgacacccccggccggccgggcgaccagcgcgacggcgactgcgacgtcatcgccgccagtacgagggacgagcacgaggtacgcgaatccctcgtcgcgtccctcgccaaggccgcccaggcgttcgccgtggacccggtggacctgccggagatcctcgtcgagcacatcggcatctccgacagcgtggacctcgacgagctgctgacgacgatccgcggctccgactggcgcacctcgggcctcggccgctccctgaacgcggtctgcgggcacccggccgtccagatcgccctgcgcgagcacgcccgccgggtggacggactgctgcgcgacatcaaccggacgtcggcgctcgccccgctccgctccctgcccccgtacgccgacgccgaccgcgtccggctcggcggcaacacccccacgcatctggccgacggcatccgcttccagctcgccgaggaccgggtgcaggagctgctgatgggcgaggagctgtacggcgaacgcgagctggcgatccgggagttgtaccagaacgccctggacgccgtccgttaccgggaccgccgtaccgaatacctgcgcaggaccggcgagatgcccacgcagtgggacggcctcatcgagttcgtccagaaggccgacgcccagggccgcccgtacctggagtgccgggacaacggcgtcggcatgggcctcgacgagctgcgcaacgtcttctcccagggcggcgcccgcttcgtcgacctgccggagtacatcgaggagcagacggcctgggccgagctgggcgagccccgcatcgagctgcaccccaacagccgtttcggcatcggtgtgctgagctacttcatgctcgcggacgagatcgaggtgacgacgtgccgcatggcccgcgacggccgccccggcaacaagtaccaggtgaagatcgcgggccccgggaacctgttccgcgtcgacgacctggggccgggcacggactccggcacgacggtgcggctgctgctgaccgaccacaaggagcgcgtgtcctgcgtggacacgttgcagcgcgtgctgtggcttgctccgtaccgtacgagcgccgagcacggctcacggcggcacgagtgggagccgggacagctctcgctcagcggtcccgagctggtctgggcggatgactcggagatgttccggcgcaccggcgcctgttacccgtcggggaacccggacgtctggtgggtggacggcacgggccgcttcctctcggacggcctgctcgcgagtaccaactcggcgaccaccggcagcagcgcccgggagcgctacggcgccgtggtcaatctccgcgaacagcaccagccggagctgagcgtcgaccgcaagacgatccgttcgaacgacgaggaccatgtcaacgcggtgctgagcgaagcactgccgagcctgttctcgaccgcgcgaccgcttctggtgcctgactggctggtcgaagccagccggtcctccgtgggcttcggggacgaggtcgccgaacgcgcgcgtaccagcagggtgccctggcccgcgggggacaccgaacgccccttcgacgcgctggggttcttccgccccgaccagacgcttctgccgctcgtgaccggccactacccggcggtacgggaagagcacggaccgtcctatctccggctggtacccacgcccgtactgcggtggcgactgctcacgctctaccgggccggcctgggggatccactgaccgaggccgcgcaggcatctcctccgctgccctgcgcacgcccctcggaccatcagctgctcagtgcccagggctcgtacaccacgctcaactggacccagagatacaaggactggctcaccggaccggagaacagcaccttctatctgctcaagagcccgtcccgcaccctggtggactccgggatcctgagcgcccacagcgtcgaggtgtggcgcgatcccgagcaggtggtcaccctcgacgagatcttcggcctggtgggcctgaccgaactcaccgccgaggccgtcgccgagcgtctgacggctctggggtactcggtcgttcctccgacgggctgcgagagagtccggcgggaggatctccctctgctccgcccgctgggctcggtgaccgacggctggctggagcccggcagcgacctgtcagtggctcagctctgcctcagcgcggcaagggccgagtgttccactcgtgaggcggccgaccggctccgggacctgggattcgccgtccccaccgagtatccgaactccgacgcctggaccgcggaagaccgcgaggtgctgcggggactctgggatctgcacgcggatccggtgccaccggaccgggcccgggagatcagctacgcccagctgatcagcgtggcacgcgcctccggtgcgaccacacaggcggtcgtcgctctgctgagggacaccggcttctccgtgccctcccctggcacgcccggcctgatgttccgggacgaggaatgggcgctgctcgtctacaacggcatctccctcaatgtggaccgcccggtcccgctgccccatgtggtgggggtggcgtaccgcacggggcagacaccggaggcggtcgccgtacggttgcgcgcgctgggcttcgaggtccccgaactccccgccgacgggccgctgccgagtaaacaggacatcaacttcctctacgcgcgctacgaatcgtcgtccggcaaggcatggccccggccggatcgcccgatggggctcggcgcgatcgcggagcgggcaggccgttccaccctctccatgacggaaacggccgccagactgaacggcttggggtaccgctgcgccccggctcagtggctgctcgaccggttccaggaacacgacgtcgaagcgctccggtggaccctgcccgacgatgaccatcagaccgtgatctctcccccgcagttgtacgcggtggccgaacacctggggcgccccgcggaggatgtcgcgcagtcgctcacggacttcggctacgacgtcgccgagatccccggcacccggatccaggagcggaaagcggaagcggatctgatcgacgtcctctcaagcggagaagacccggtcatcgacatcgcctacgaggccgagctctcgcttcccaccctcgccaccgtggccatgcgcctggggctgcccttccggaccgtcgccctcaaggccaccgccctcggcatgcgccacgaggccgagacctggttcgccgccggctga

SEQ ID NO: 22 - DNA, 1374 bp, Streptomyces Sp.
atgagggccctaccagccccaccccgcagaatcgccctactggcactgtccgcactgctcctcctggtaccggccctgtggccgcggctgacgcagcccgcggcggccgacaccggctccttctcactgctgtacgaccccggccccgcgcacgactgctatgcgctggtcgtggaggacccgccggacaagaacacgacccccgatcccggacgtaccagcagcgccggctgcgatgccttcgccggcaccgaggagttcacccggaagagccccgagcgccccacctgggacatcggcacctacggatggaacacctccaactggggcacctcacccggctactcgttcaccacccagaccgccgccaagacggtgaccatgcggaacgacgcctccggggtctgcgggctgcacgagaccaacgtcagctacacctaccccgactcccagctcaaacccgggcccgaccgcgcgtaccgcaccgcggcggacggccggatcaacgtctcctaccgtgcgaagatccagcagaccgagcccttcacctgcggcgagaagcgcgcgctcctcaccacggacctcatcttcgaggactccgagcacggctcggcacaccctgacgtgatctccgtcatccactacgatcctggcacgttcaaggcgcccgacagcaacggtgtcgtctggtacaccagggacgacacgacgatgacctgtcccgacggctgccgggtcatggtgcgcagccccgacctgatgaaggacgccacctgggcgtcgatcgacgacgacttcagccagctgttcgacaagtacgtcgactacgtcaaccccgagcacctcccgaagtccgacttcgtcctgcgtggcatccagatcgtcagcagcaacacgggcagctccacgacggcctcggtcagcgacgtcgacgcgcggatgacgccgaacgcacccgtccacgcacccctgacgtacggcctcaagggcagcgacgggcagtccctgtgcctggacgactacaacaacgccacgacgccgccggccgtcgccgacatctgggactgcaacggcggcgacgcgcaggactggaccatcggccaggacgacaccctccaggtccacggcctgtgcctgggcgtgtccggagacggtacggccgaccacgcgcccgtcggactcgaccggtgcgacgggggagcgcaccagaagtgggtcctgggccgctacggccagatctacaaccccgtgtccggccgctgcctggaggtcgcgaacgcgtccgacaccaggggcgacaagaacctcgaactcttcgactgctggggcggcgcccagcagaagtggtggactccggccggcgactaccgctga

SEQ ID NO: 23 - DNA, 7827 bp, Streptomyces Sp.
gtgcgctggttcgcaaccgtgcgcagacggatatgggggcgcgggctgacggtggcgaccgcaaccgccgccgtctacaccctgattgtgtcggcggccgtcgcccaaggggtgccggagtatcactacgacggcaaactgtggagcgccggaccgacgtacaaaacacccagtgtcggcgggcaccccctggccggacgcacccccgcaacaccgaaaaccaccaagccgctgcggacctaccggcccgcccgcccggcgtggccgtccgccggcaccagcaccatcgcgctgacccagagcgccaagtcctctgccaccacgtcgactccgcagcaccagaccgcagacggaccggcgacttcccccgtccgggccggcaagctgccggtatgggtcgctccggccaagcaagcagcgaagaagcgcggtgcggccccgagcacgccggccgccgtgcgcgtacaactggccggccatgcccaggcccaagcggccggagtcgacggcatgctgctcggcctggcacgcgccgacggcgccgcgtcctcgggccgcgtggccgtcaccctcgactactccgccctggacaaggcatacggcggcgggttcgcctcccgcctgcacctggtgtccgtacccggctgcatcctgacggcgccccagaaaccctcctgccgggtacgcacaccgctcgcctccaccaacaacccggtcgccagaaaactcacggccacgctcaacctgccccgccccacgacctccggcgcggctggcgcgagcgcgcatgccggcggcacggccggctctgcctcagtggcaccgatgaccgccgtcgaggccatctcgggagcttcgggttctcaaggtgactacacggccaccagcttgaacccctcaggcagctggagcgccaacggaaccggcgcgttcacctactcctacccggtcgccgtgccaccctcgctcggcggtgcggccccttccgtcgccttctcctacgactcccagtccgaggacggagagacctcggcccgcaactcccagtcgtcgtggatcggtgacggctggtcgtactcgcccggtttcatcgagcgctcctacaagccgtgcaagcaggacggcatcagcgactccgccgacctgtgctggggcggctggctcgccaccctttccttgggcggacactcaggaaccctggtccgcgacgagtccggcaaccccgacacccccacggcgaaccagacctggcacctccagggcgacgacggaaccaagatcgaggaactcggcggcgcggacaacggcctgtggaacggcgagtacttcaaagtcaccacgaccgacggcaccgcctattacttcgggctcaaccatgcccccggcaccacctcggacgcggccaccaacagcgcctggggcgaaccggtctacagccccaagtcgggagacccctgctacgactccggtcagggcaaggactcccagtgcacgatgggctaccggttcaatctcgacttcgtggtcgacccgcacaccaacgtccagcgctacacctacgccaccgaaaccaaccattacgaccggggcggtggccaagtggccgcctccggcggctccggaacgctgaccaagtatgtccgcggcggctacctgaccgagatcgactacggctaccaactgacggacgagaccgccggcagcaagcccggcgcgcgcgtgctgttcaagacggcccagcgctgccagacctcgtcgacattcaccgactgctcgtacgcgaacctcaacgacaagaccgccaccaactggccggacgtcccctacgacctgaactgcgcatcgaccgacaccacctccggtaccgggtcgaacgtctgcctgaccacggccccgtccttctggtccaccgaccggctggactcggtcgtcacccaagtcaacgtgggcggcaccctgacggacgtcgacacctatcagctgacccagacgtactccgacgcgggcggcacggtcgacccggtcaccggacagtccggcaaagacgcggccgacgagggcgagctgcaatcggtgatgtggctcagctccatccagcacaccggcgacgacaccaccggcggcggcagcaccagcccgatcaccctgccgaaggtcaccttcctgggcaccgagatcgacaaccggatcgacggcggtaacgagccggcactgttccaccccaggatgtcgtccgtcaccacggagaccggcgagtccatcgccgtcacctacagcgacccggactgctcccggctgaaccacacgatgccatcggcgcccgatgccgacacgatgtcctgctacaacgtgtactggaccatccccggcggtgtcacaccggtctccgactggttcaacaagacccgggtcaagacggtcaccgtttccgacgggaccgggaccgggtcgcccgcacaggtctcgaactacacgtattccggacctgcctggcatcgcgacgactcggaactgaccgacgacacctaccgcacgtgggaccagttccgcggctaccgcacggtcaccgtcaccacgggagcgggttccgatccgatcacccagaagaccaccacgtacctgcagggcatggacggtgacgtccgcgcggacggatccaagcgctcggtcagtgtgacggacagcgtcggcgacaccgtcaccgacagcgactggctgagcgggacgccgctggaggccgacacctacacacaagccggcggcagcgtcgtcgccaaacaaatcgaccttccgcagacgttcaccaccacggcgacccacaacgccggttcctcgctgcccgccgtcgtcgcccgcatgatcaagaccagtcagcagcggacctacgggctgctcgcggacggcagctggcgtgaggccgagaccgacacgtcctacaacggcgatgccctgcccaccaccgtcgacgccaagggcgacgtcagcgtggcctcccaggagaagtgcgccaccaccagctacgccaccccgcccagcggcaacccgatgatgctctcctacccggacgaggtcctcaccgtcgccggcccctgcagcaccacaccgggcaccagcaccaccgtctccgacaagcggatgttctacgacggcgacggcacggtcaccaacgtggggacgttcggtcacctgggcaccaccggtgacctgacagcaacccagatcatcaccggctacagcagcggagcccccacctaccgcacgacccaggcgaccgcctacgacatctacgggcgcgccatccaggtccaggacgcggacagcaacaccaccaagaccgccttcacccccaccaccggacagctgccgacccagctcgtcaccaccaacccgcgcacctggaccaccacctccgtcatggacccgctgcgcggcctgaccatgaccagcacagaccccaacggccgcaccaccaccatcgactacgacgcactcgggcgccgtaccgcgatgtggctgccgggacgcccgacctcgcaaagcgccagcagaaccttcacctacgccgtcaacgacacggcaccgaccaccatcaccaccaacaccctccgtgacgacagcaactacagcaccgccatcgacatctacgacggcatgctgcaactgcgccagacgcagtccaccacggccaacaaccaggccggacggctgatctccgacaccttctacgacagccacggctgggcgcggaagaccaacagcacctactacgagagcagcacctccccgacgaacacaatgtgggtcgccgacgacaaccaggtgccctcgcagcaagtcaccgtccacgacgggctcggacgcaccaccgccacccaactgtggtccaagggagcgcagcggtggcagtccaccaccgcctacccgggcgtggaccgcaccgacaccaccccgccctccggtggcacggcgacctcttccttcaccaacgccctcggccagaccaccgccacctggatgtacgacgacacggcgacgcccaccggcaaggcatccgacgccgtcgtcaccggctacacctacacacccgccggacaggtcgccacgatgagcgacaacgcgggcaacaagtggacctacagctacgacctgctcggccaggagaccaagcagaccgaccccgacaccggcaccaccacgttcgacaagtacgacgatctcggcaacctgctgcaggccaccgacgcgcgcggccagatcctctcttacgcctacgacactctggaccgcaagaccgccgagtactcgggcgcctggtctgccaccccggatccgagcaatgagctcgcgtccttcaactacgacaccctcgccaagggataccccacctccgccacccgctacgtgggcggcgccggcggggacgcctacacccaggccgtcaccggctacaccaccgactaccagcccaccggcggctccaccaccatcccgacgtccaccggtttccccagcaacagcacgggcaccaactccaacacctacaccgtcaaataccactacacccccatcatggggctgctctccgaagccgactatggcgcggacggcggccttcccgccgagaccctcggctacggctacgacctgcagggcctgctcgacggattcggcggcaacggcacctacctcgacaccaccgactacacccccctcggccaggtgaaagacaccaggtggggactgtacggagaacaggtcgagccgaccttctcctacgacgacaccaccggccgtgtcacgcagtcccaagtgaacctgcagacgagcgccacctcggcgctcgacgtcaccgactaccgctacaaccaggcaggcgacgtcaccgcagtctccgacacccagtccggcggtaccacggacacccagtgcttcacctacgaccacctgaaccgactgaccacagcctggaccgacaccgcgggcctgacctcggccggcgtcggcagcaccggtgcctgcacgaccagcacccccttggcctcgaccactggcggccccgccccctactggcagtcgtacacctacaacgccctcggtgaccgcacccagcaggtacagcacgacaccgccggcaacaccgcgaacgacatcacccagacagcgacctacccgggcagcggaaccacccccgccaccctcgcgaacgccgccaccaagatcaccaccaccggtcccgccggcacggccacgatgacaccggcctacaacggagccggcgacaccaccggccgaaccgtcaccacggcaggcccgctcgtctccggccaaacccgctcaggcaccaagctgtgcgccgacgactcctcctccggcaccaccgacggcaacaagatcgacctctacacctgcaacggcagcaccgcccaacagtggacgatcgacaccgacggcacggtgcgcgtgctgggcaaatgcctcgacgcctccggtggcgggacgaccaacggcaccaaaatcgacctctacacctgcaacaagagcgctgaacagcagtggaaggccggcgccaacggctcgctggtcaacccggcctccggcaagtgcctcgacgatccctccgcatcgaccaccaacggcactcagctgcagatctggacgtgcaacggaacaccggcgcagcgctggaccaacgcgaccatgggcaccgtcctgcccggcgccacccaggcactcggctacgacgccgaaggccgcacggcctcggtgacaaccccgtccggcggcaagaaccagaccaccagctacctctacgacgccggcggcagcctgctgctccagaccaccccgaccagcaagatcctctatctcttcggaggcgccgaacagctcaccctcagcaccagcggaggaacggtcacgggccagcggtactaccccggcccggacggcatcaccgaagtacgctcctccgccggcacgctcacatacgaagtctccaacgcccagggaacggcgacggaaagcctcgccgcctcgaacctggcggtcacccgccgctacttcgacccctacggcaacccccgcggcccccagcccacgacatggaccgacaaccacggctacctcggcaaacccgccgaccccaccaccggcctcaaccttctgggcgcccgcgactacgaccccgtccagggccgtttcctgaccgccgacccgctgatggaggccggcgacccgaaccagatgagcggctactcctacgccgccgacaaccccagcaccggcagcgaccccaccggcctgcatctggcctgcggtgacggggacgacccaccctgcccctcaggcggcggagcgtcgatcggcggtatgggcggctcctcaaccaccggtggcggcgggggagggggcggcggcaccacgacctccagcggcggcaccgcagcggctccgtccgccggcccagcctgcaacgtcgcatcgaagttcggctgcgatgtcgtcgacgcccagcagatggcggacaacgggccgccgacgtccggaaccctccgcgacttcatcgccggcgcgctcgatgagttcgtacaccagcttgagcaactcaatccgggttgggcgatggggaacgttccccatgacgtggcgaacggcatggcaccaggcatcgcgggcccgccgcggtacgtggagccgcgccacgtcgtggcgcacaccgtgcacgcgcataccaacacggacgcttacaagggcggcgaggccacgaccgtcctgctcgagttcgctgccagcggcggcgacgacgcccccgaggcagccgtctcggccgtggccgatgccggcgacgctcaagacggcctcgcggccgctgccgaggtcaagaacgtcgtcagccagaccacgggagaagccacagcaaccgccgcaactcccagcgagcccgccaccggcgcctccggcaccggagaaggcccctgcagcttcagcccgtcaacccgcgtattgctggcacagggcaagaccaaggcgatcgctgcagtcagaccaggcgacaaggtagaggccgccgaccctgacaccggcagacaccggggcccccgaaccgtccagcacgtgtggatcaaccacgaccacgacctgctcgacgtgacgatccgcaccaagggtgaccacaccgccacccttcacaccactgccaatcaccccttctgggacgacaccacccacagatgggtgcccgccggcaaactccaccacggcgacgccctcaaaacctccagcaatggccacgcctacatcgtggccagccatgccacacccggcaccgcaaagcgttggaatctcgccgttcagcagctccacacgtactatgttgtggcgggcggcgtctcgatcttggtccacaattccaatggtccggatagttgcccggtactgggggctgcacgagcggcggctgatacggcatcggcaatcacgccgggtaaggcgagaccggcagtggcagaggctcttcagttgccgggaggtcagatctattcgagtcctagcattcgtggtgtggctcccgagcttcactccgacgttcaagccattttggatgatattcctgagggcgaacgaggcgttggtcatggaagatgcgggctggcagtgtgcgtgtcggatgctctgagtgatggattcaacccaaccggatctcgtgctgcggcggttatcgtgcgaagttcgaccgataatccaatgcatggaatgcctgtcgggccatgtgatagttgcgtagccctcgaagacgcattcgatatcaggtttgaggggatagggtag

SEQ ID NO: 24 - DNA, 4335 bp, Streptomyces Sp.
atggggggaagaacgcgcctgtcctgcaggcgatggcgcaccgcgccgcaccacttggcggtcatggcggtcctttgcacgctggtcctcggggccgccccgaccgccgccgcggacagcagcggtcccgtccccggcaaccccacgcaaagcgccctcctgcaggcgcaggccaccgacaagcccgtcccggtcgactcgctgaccagccagacgacgaccaccacggcgaatccggacggatcgctcacgacgaccgagtacgtccagccggtgcgggtgatgaaggacgacgcgtggacagcggtggacgcatcgctggtgaagaacgccgacggttcgctcagtccggcggcgacgcccaacgacgccaccctctcgggcggcggcagcggtcctctcgtcagcctcaccgacccggccggccgcggcctgtcgctctccgtgccgttcacgttgccggctccgacggtcagcgggaacaccgcgacgtacgcgtcggttctgcccggtgtggatcttgaagccaccatcagtgatcagggcggcttcagtgacgtgctgatcgtgcacgacgccacggcggccgccaacccggatctgcgccggctgaccctggcagcaaccacccagggactcacacttgccggttcagccgacggcgggatgaccgcgagcgcggcggacggcaccaccgcctacaccgccagcgcccccatcatgtgggattccaccaccacaacggccggcccgcagcccgcgtccatgcatctggacgacgctacgtccaccactccgccgcctcccgacgggccggcgccgggagccgacgtcgcgccggtgaccatgacgaccaccagcaacagcctcaccctcacacccgacaactccatgctcaccggcaccggcaccacctggccggtgtacatcgacccaggtgtgctaccgagcgagaccaccaaccactacttcgaagctcagcacggctgcaactcctcctccgccagctcccacgagtacgactacccgcagcgcttcggcgaaggagtcggctaccagcgctatgcctcgtccaacggcgactgcatcggcgccgagcgcgccttctaccaactggacaccagcaacctcaacagcagcatggacatcatcaagtcggagctgcatctgacggagacctacgccgaggcctacggctgtacgcacacggcgcccctcaccctcaagtggactggaggcatctcctccggcatgtactgggacacccagcccagcgtggtctccaccatcgccacgaagaatccgtccagcgcctacaacggcgcctacgccagccagcccaccagttgcggcgatcaggacgtcgtcttcacggtgaccgacaagatcgcaaagatcgcttcagacaacgactccacctggacggtgggcctgtacggcgacgaggactcctcgagcagcaacatcgacttcatgcggtactccaccaacccctacatccaaaccacttacgacatcccaccggatactcctaccagcgagaccaccacgcccgacgcgcacaatccctccggtgccaactgcgggagcagtacgcgcggttggatcggtcagacgacgctgaacggcaacaccagtgacatcacgctcaacgccaagctgacctccaacgtcaagggcgagaacgtcaaggccgactacacggtctgggacgaccagaccgccaacagcagcggaaacgcggccaccgtcgcaacaccgagcagcagctacgtcgcctccggcaccacggtgcacatcagcatcggcaccacggtggaggacggccaccagtacggatggcaggtccgcgcctacgacggaaccctgtattcctcctggaacagcccatgcggcttcaaggtcgacctgaccccgccgtcccagccctcggtgaccgcgccgagtgccgtgttcccgcccgccggaagcaaccaggcacccaccgggtacgccggccagaccagcaccatcaccgtcaccagcagcgaccccacgccgaccggatgcacccgcggcacctgcctgtccagcgacgtctggcggttctgctacgcactcgacgtgcaaccggccgtcaattgccccgactacgtcaccgcgaccaccaactccagtggcacaccgagcgcgtccatcccgctggacccgacgacatggggcactcacaccctctacgtcgaagcccaggaccacgccgggaacacccaggctctaccgaccacctacaccttctacgctccctggaacccggccaccaaggtcgccgcaggcgacctcagcggagacggcgtacctgatctgctcggcaccaccaagaacggcgacctcacgctcctgccgggcaacaccgaccccggcaactcgcccaccctcgcctccaccgcatcccagagccccgacggcaagaccagctggaacgactacctgatcacccatcgcggcagcatcaagcaggacggcctggacgacctgttcgccaaaaacagccacaacctgtacgtctacaaaaacgacggcgccatctcctcaggcaccccgggccacttcaccaacaccgcggacgtctacgggccgctcgacaaaccccagtgcctgcccaccgcggacaacgccaccaactgcgtcacgtacaacgcggccgactggtcgtcggtgacccagatgatcgcccccggcgacgtgtacggaaccggctaccccgacctgatcacgatcgagaacaagcaactctggctctacaagggctccgcccaggacagcagctacttcggacccgcaaccggcggcaccaccagcaccacacccgtactgctcggcaccggcgactggtcccacttcaccctcatcgcacccggaaccgtcaacagcacccccgcgctctgggcccgggacaacaacaccggaaccctctacaccttccccctcaccgctgacagcaacggcctgcccccgctgctgacagcgcccacctcttccgcgctcacttccgggctcaccgccgccgacggcaccagcctgtgcgcggacgactcccacgccgccacccagaacggcaacaagatccagatctggggctgcaacaacacccacgcccagtcctggacacctgccgcggacggctcgatccgcgtactcggcaagtgcctggacgtcacccacggcggcaccacagacggcaccctgatcgacctgtggacgtgcaacggtaccggcgcccaacagtggaagctcggctccaaccactcgctgctgaaccccgggtcgggcaagtgcctcgacgacccgaactcctccaccaccaacggaactcagctacaactgcacacctgcaacggcaccggcgcccagagctggacctccagcacaccgagcaactgggccagcgacgccgccaccgctctgcccgtcacgctcgcggccagtgactacccgaccgtcgcctcacccggaaacctcaacggaaccaccgcgggctatcccgccctctacgccaccacatccgccggcgaactcatcgaataccccggcgccgcccccgacaccaacggcacagccaccttcggctcccccgtgacagtcggctactacaacaccgcgaacgccgcctggcccctgaacgacgacaccgaccgcaccgcagccgattccatcggcaccaacgacgccaccctcaacggcgccgccgcctggaccagcgactcaacccgcggaaccgtcctcagcctggacggaaccaccggctatgcccaaagcacctccagcgccctgcccaccggcacccacaccgaccccaccgacggcaccaccaccgacaacaacagcttcagcgtgtccgcttgggtcaagctcaacagcctgaccaacaactccaccttcgtctcccagtccgacagcaccggcaacgccaacgcctaccagctgtactactcctccggctcccagaaatgggccttcgaccgccacgacgacgacaccaccggaaccaatttcaccgccgtctacggcgccaaagccaccaccggcacatggacccacctcgtcggcgtctacgacggccccaccaacaccctcaacctctacgtgaacggcaccctcaccgcgaccaagacgttcgccggcaccccctggaacgccaccggccccgtccagatcggccgccgcctctaccaaggcacctatggcgaatacgccaacgccgacatcagcgacatccagctctacaacaccgcactccccccatccgaaatcagcgcactcgactacgaccaaaccccctacacacaactcagctaa

SEQ ID NO: 25 - DNA, 2067 bp, Streptomyces Sp.
atgccaccccccaccgtccgccgttcccggcgcaggctccccgtcgcggtgctcgcggccgccctcggagcggtcaccctcggcgccccctcccccgcgtccgcgtccccgtcggacgccgccgaagaggcgggccacctcgtcgggcgcggcatcgcggatgtcacgggcgaggcggccgagacggggatgatgggctactccagcttcgaccagaagacctcgggcatccaccagcggcagcggtcgcgcgccttcgtcgtcgtcgaccggtcgagcggcaagcgcgtggtctacgtcaacgcggacctggggatgatcttccagtccgtccggcagggcgtcatggcccggctgaaggagcggtacggcagcctgtacggcgaggaaaacgtcctgctttcggccacgcacacccactcggggcccggcgggtactcccacaacgtcgcctacaacctctccgtcctcggcttccagaaggagacgtaccgggcgatcgtcgacggcatcaccgagtccgtggccaaggcgcacgacgacctgaagcccggcaccatgagcctgggcacggggaccctcaccaacgccagcgtcaaccgctcccgggaggcgttcgaccgcaatccggccgccgaccggtccgccttccccgacggcatcgacccggcgatgaccgtgctgcgcttccggcagggcgggaaggacgcgggcgcgatcagctggttcgccacccacaacacctcgatcaccaacaagaacacgctcatcagccccgacaacaagggctatgcctcctacgtctgggagcacgaccacgagggcgtccgctatctcgacgacaccccggggttcgtcgcggccttccccaacaccaacgccggcgacatgtcccccaacctcaatctgaagcccggctccgggcccaccgaggacgagttcgagaacgcgcgcgtcatcggcgagcgccagctcgacaaggcgcgcgaggtgtacgacgacgcgcggcccgtcacgggaggggtcgactcccggatcgcgtacgtcgacatggagaacgtgaccgtacggccggagtacaccccggacggcaaggagcaccgcacctgccccgccgtggtgggcgcgtccacactcgcgggcagcgtcgaggacggtccggccatccccctcttcgaggagggcatgcgcacgccggtcgccaccgtcctcgaagcgctgcgcgtcgacaccccgtcctggctcgccacctgccagtaccccaaggcgagcctgatccccacgggcctgctgagcaacgtccacccggtgaccccgaagcggctccccctccagatcatgaagatcggcgagctgcacctggtcgccgccccgggcgagttcaccatcacctcgggactgcgcgtgcggcgcacggtggccgagcggctgggcgtaccgctggaccgcgtcctgctccaggggtacgccaacgcctacagccagtacgtcacgacaccggaggagtacgacacccagaactacgagggcggctccacgctctacggccgctacaccctgcccgcctaccagcaggagtacgcccggatcgcggactccctgcgcgcgggcacggccctggagcggggcacgatgccggcggacgagtcggggcggcagttcaccttccagacgggggtcgtgtacgacaacccgccctcgggcaaggcgttcggcgcggtcctgaaggccccggagagctcgtacgctcgcggctccaccgccaccgcggagttcgccaccggccacccgaagaacaacgtccgccggggttccaccttcctggaggtccagcggctggagaacggcacctggcagcgggtgctggacgacggtgacggggagaccgtctaccgctggacccggatcaacggtctgaccggcacctcgaaggccacgatcacctggcgcatcgcggcggacaccgcaccgggcacctaccggatcgtccaccacggggacgcgaagaacctgctgggcaggatcacaccgttctccggggcgacgggtgccttcaccgtgaagtag

SEQ ID NO: 26 - DNA, 2421 bp, Bacillus Sp.
atggttcattttaaaaactgccctgatccttctctaaacgccaattctcagtctcaccccgaattttcatctgaattagaacatattaaggcaagaatgcaaaactttattaagcattccgttacagatcaaaatatcgaagttactgacgcgagggtgacggctgaaggagagatcacctctcttttaaaagaacgtctcgacaaggagtactttaaacttttatctaagatcacccgggaagtaaatgtggaagacttcggcgctgttccagatggaagagataatacggaagcttttcgaaaggcaatcgggaatggtcgcgtcaaagtgaacgttcccgccggagaatacctcgttcaggggattaaacttccatcctggacaacaattgtcggacaaggtaaagggattactgtaattaaattgcatgaagacactccagcacatgaatgggtgattactaatgatgattatcaaaatgggaatcgcaatattttcgtccaaggaatgtcattagactggaatccaagtagacaatgcggagtgagaaatcctgggggacagttctccagttgtttaacttttgctaaggttgaatatggatggatcaaagatgtggaagctattaacgcaggtcttcatggtattgatatcacatcgcctacgtatgatcatttgcctgataccgattggacaaaagacggatcaagatatatttggattgataactgtgtgacatacggttcaggagacgacggcattaccacccattacagcgaatacatctttatttcaaactgccattcaggaaatccgcgaggaacagagtttgtagaaggtgtttctaactccaacggaatagaagttgacgacggctctaggcatgtgtggcttttgaataactttacaagcggaaacatccgcggagtagaagtaaaagcccatgaactgtggccggcctctcaaaacgtccatatcataggccatgtttcttatcgcgatgttcgtgcatttgatcttcgtcatattggtcaccatcaaattacagatcctgaaagcacaacggcatacgatgtcacactcattgattgctcagcaattgaaccagttttcaactcactttatgatgctgtgacacctagagcgctggttatttcagcatataaaaacgttaatgtaagcggattcacagcaattggtgatccagattatgattataaaggaaatcctgtcgtggctttgcaatatcgtagtcaaaatataaccattaatggtattaaaattcgcgggtttaaaaaagctggtgttgatattaatttatccggcggatcaaataaaactgattatattaaaatttcgaatttcgatatttataaatctgctccaaaaggaatttcaatcggtggcggtctctataatgtgaatatactaaatggaacgatgattactgataatgggacagttggaatccagtcgcccaataatcaggccacaattctcggtgtacagtcagaaggctatagtgtagcagcctcaatcaaaggtcaaacataccaacaaatcccaatcaatttgaaaggaggcatacagcttgcaacaacctctggttttgccgttaaccaaacaagtgcagttatagcaggtaccggtgacattacggcgcgcggagaaagaaatgcggtcattagctcttctggtggctccagcacagaaggctctcgcgcattaatcgcttcttcaaacaatgcacatattaaaggaaaccatgtatcaagaacaatactgtcttctgaaaatattatacttgaagaaccatacaccgtggcaggaggtcatcaatcaatgaaatggcttcttgactctgttaggggaaacgggacgtttgccggggcgatcagttcttctttaggtggatatggagagtattttgagagttcaactggacaattaatccatactggtacaatcgtgactttaagaggtgaaaaaatagcacccgcagatgtaggagattatatgcttggcgttatttcagaaacttcagctttcatttcaggagcatccagtttcgtctggcagggacgttatttaactaatgagtttggcggattcatttatgaggtggtaactgacgaggaaagcggtgaactcatacgtgttcccaaacaaaatccagactatgatacagcgctggaggcaaattatcattcacgggcagcaagagacgaatggcatgtagtagggttggtaggcaaacattatgtgcgtattgacgaaactgtcagtcaaggaaattatcttacggcacataatggaataggaacaaaagcagctgaaggaagctggaaagtaatgaaaataacctctgcttatacgtcagaaaaagggtatggtatcgctctgaccgtcatcaaatag

SEQ ID NO: 27 - DNA, 801 bp, Streptomyces Sp.
gtgatcaacatccgcatccgcacagccgccggcgcagtcgccctcgcctgcgccgtcgtgctcacccccgagatcccggccgccgccgcccccgcggccgcgaccgaacccgccccgttcagctgcctcgaccccagcggggaggcgctctggagcggcccccagtgcgacggcgtcatcgtccgcgaactcggcaccgaggccgtcgccatcctcctggacggccgccggatcgacttcgccgacgaggccgaactgcgcgccgacgactgcgccgtccggcccgccgtcaccctccccgccagcaccttcgagaacctccccaagggcccggacccgctgtacgccgccgtggaccgccgggtggacgtaccccgcatcatccccgaaccgcaatggcgcaagaactgccacccgctcttccgctcggacggccgcgatccgtccgtcatcttcgaggagggcttcggcccgaaggacaccgtcaacggccagtacgacatcaccagctacgtcctgcagaaccagccctcgccgttcgtcagcaccacctacgaccccgagctgtacaagaagtggaagaaggtgccctgggactacttcatcgacgcccccggcggcatcgacgtcaacgcgaccatcggcgaccagcaccagtacgccgaccaggtcgaagtcgcgttccccggcggcgtggaccggcacttcatccgccgggcctgcccggtcgaccgggccaccgcctccctggtcgaggccggctgcgtggacaacccgaactaccagccctggctgcactga

SEQ ID NO: 28 - DNA, 3216 bp, Stenotrophomonas Sp.
atgacgcacgttgcaacacggaacaccttgcagtcccgacttcttcttctgccgctgctttccctgccgatgacattggcaactgcggcaaacaccctcgaaaccgttcaagtcaccgccacgctccctgttggaggtggcggtgcaggcggttttggatttggtggcggcagtggtgtccacctgtccgagtcacagatggacaatggcggtggcggcggtgcaattccgaccgaaacggcgaaggaacagccgaccgatgacaaggagaaggactgtaatggccgcaagggcaatcctgtcgtgctctacagcggcaacaaggtcgagccggaactcgatttcgccagccagggcgaaatgggcctgttcctgcagcgcaactacaatcattactggagcgcgaccggtctgttcggcaatcactggctgagcaacttcgactattcgctcgcgttcaccgatgcaaaccagctggcgtgggtacaacggcccgacggtcgccgcatcaagtatctcaaggatccagccagcggccgctggtacgaggacaaggcccagcccatcgcgtatctcgccgcgaacggagacggcacgttcacgcttcgaaacgaaaacaacgggacggaaatctacaacgccgagggctacatcacccggctcagcaatgagcaaggtgtgagctggacgttctcctataccgatcgctacctgcagaaggtcacccactcctcgggacgcagtatcagctttggctggaccaatggacaggtctcccaggtgaccgacccggccggcaacatctaccgctacacctatacccccaacgtgttcgggaatgggcgtgggcggctcgccagcacgacattgccaggcgctcctgcaacgacgatcagctaccactacgaagacggccgcttcccgggtgccctgaccggcaagtcctttgacggcgtgcgctattccacgtttgcctacgacgcggagcggcgcgccatcagcaccgagcacaatggcggcatcgaacgattccgcttcagctacgccgtgcgcagcaccgaaccggtgcttccgccccccgcccccgctcgaccgggcggtgtccgcgccgacgaagagcgtggatggtgcgagcagcgccccggaggctcacgcatctgctaccagccgcgctcgctgcctgtcgattcgctgccgatggagagtgctctcggcatgaccgccgccgctgcgccgagccttacgcggcccgtcgatatcgatgtcactgtgatcaaccctcttggccgcagcaccacctacacgttcaaggacggaaagattgtgtcgaccaagggtgatccgtcgccgaactgccctgccagctacaaggagcagagctacgacgccaatgggtaccctgatctggtccatgatttccaggacaatctgaccaacttcgactacagcgcacagggctacctgctgaagcgggtggaagcggtcggcagcacggccgaacgtacgacgttgcaggagtgggataccgcgcgtaaccggctgctcaagaccacggtggtgggtgatcttgaagtcgcctacacctatgacgatcgcggaaacgtagccagcgtgactgagcgcaatctgacggcacgtggggtgcccagccagacgcgggtaacccgcaccacctatagctatcacgccaatggattgaaggcctcgatcaagatcgatggcccgcttccgcaggatgacgtcacctcgaccttcaacaaccagggcgatctgaccagcaccaccaacgctctcggtcatacgatcagctattccaacttcaacggcttgggattgccgggacgtatcgtcaatgcgaacggtggtgtgcgggagctgacgtatgacggtcgtggccgcgttgtgtccgacagaaccagctcgggaaccggctgggcgaccacagccattggctacacctccgcaggcgacatcgcctcgctcacccagcccgatggcgtgacggtacgctacggctacgatgcaggacgccgcctgacgcatgaagtccgctcgctgggagacggtacgtgggcgtggacccgtcatagctacaacaacgcttccaatcgcacgcgtaccgaggtttcacagaccgactatccgatcgatacggcagtcaagggaatgattgacgaaatcacccatgacgggcagtggaactggttcgctcgaggctgggcctgctccaccggatcggccggatccatccaggtggatggctacgccgaaggcaacgtctacctgggaagcacccaggcaaacctcgccagcgagccaggggttgctgccgcctgccaagcctcaggcaatggctatagataccagctgccgatatcgctggcccagaggcagcagctgggtggccgcaagttctccatctacggtgtatctccgaagggagcacagcacaaccaagcgctgggcaactccggcaacttcgccattcccacggcaacgatcatcggagacgtcgcaggggttacgaacgacgcgaactggaacttctccgtacaaggatgggcatgctccgtgggcgtcaacgcggccaccaccgtacacatctatgcgggagggccggcaggcgctggtacgtatcttgggagcgttaccggcacgctggttccgaacgacgacgtaaaggccgcatgccaatcgcaaggggcgtattggtttggcttcacgttggattccaatatgcgcaacgcacatggcggaaagcccatctacgtccacggcatctcgccctcgggccaggctcatctgctgctcaatcgctcgggtacgttcacagttcccgcgatagtgcgcaacgccgaagtcgttggcgcgtcggcctatccgtaccagatcttcaatggcggctcctcaacattgatcttcgagttccgcaacacaagcaatgtggtctggaatccaggcgatacctacctcgcgttcggcctcaatcagcccaacgagaacatcgcactctctgcgccggtgccacccggtggcgtggccaggttcagccgcagcgtggggccgaataatccgggcagcgggaatcgaacgttctcgtacgtggcgagaatggcgtccggcggcgttgcctggggcgcggaagcaaaggtcttcctgtctgttgagaacaacaagggaagttgcggtcgcgtcgtctgcgaacgccctcggtaa

SEQ ID NO: 29 - DNA, 7776 bp, Streptomyces Sp.
atggccgcggcggccctgatagccgccgtcgtacagatcccggccatcgcggtagcggccggcaacgagatcaagctgccgcccgtccagcacatcgaacccgtcccgctgacccgggtcgtggcggaacagcccgccgcgaaggccgcccagccgaagaccgcacccccggtcgcggcatggcccaagccggggcaggctgatgtcgaccttccgccgtccagggcgcagaatccctcccctcaggcgaaggcacccggcctgccgctgaccatcacctccaccggggcgaacccggcggcgggtgagcaagccaaggtcagggtggccctgtccgaccgggcggccgcggccaaggtgggtctcgacggtgtcctggtcaacctcgaaccggtggctggcagcaccacgcccgacaaggcacgcgtccagctggactacaaggccttccgcgagtcgttcggcgccgactggggctcgcggctgaccttcgtccagctgcccgagtgcgcgctgaccacaccggaccagccgcagtgccgcacagccacaccggtggccgcctcgaacgacaccaaggccggcaccctgacggccgacgtcgccgtggccgcccccaccggccagacctccgacggcccgaacaaggtatcgctcgcccaggccgccggcacgtcggtcgccggtgcgacggtgctggccgccacggccgaggcgtcgggcccggacggcaactacaaggcgacctcactctctccgtccagcacctggtcggtaagcggcaacaccggttccttcaactggtcgtaccccatcccggtgccgccggtgccgggcgacctggccccccaggtcgccctcggatacacctcggcggccatcgacgggcgcaccgcatccaccaacaaccagtcctcctggatcggcgacggctgggactacaacccgggcttcatcgagcgcgcctacaccgggtgcgcgggtgacaagggctctggcagcaatgctcccgaaacgggcggtgacctgtgctggaagtccgacaacgcgacggtttcgctcaacggcagcagctccgcgctggtgcgcgacgacgcgagcggcacgtggaagctgtccaacgacgacggctcgcgtgtggagaagctcaacggcaacgcgacggacaccgccaacggtgacaccgacaacgagtactggaaggtgaccacgaccgacggcacccagtacttcttcggcaagaaccgcctgcccggctggagcgccggaaagcccgagaccggtgcggccctgaccgtgcccgtgttcgggaaccagcccggcgagcccggctacgccccggcgttcaaggactcctcgcgcgaccgtgcctggcgctggcagctggactacgtcgtcgacccgcacggcaacgcgatcgcgtacttctacgaccaggagaagaacgcctacgccaagaacatcggcgccgccaccgggacctccaaggccgacgcgctctacacccgtgccgccacgctgaaccgcatcgagtacggtcaccgggcaggccaggtctacaacgcctcgcctgctggcaaggtcaccttctccaccagtgaccggtgcgtggagaccgactgctccttcaccgaggccaatgccgcctactggtacgacaccccggtcgaccagtcctgcgacaagggccaggactgccgcaacggcgccccgaccttctggtccaagaggcgcctgacgggcatcagcacgcaggccctgcagagcaacggcagctacaaggacgtcgacgcctggagcctggaccaggacttccccgccaccggcagcagcggcggccgggcgctgtggctgaagaccatcacccgcaccgccaaggccggctccgcccagctgaccctccagcccgtgaccttcggcggggacctgcgccccaaccgggtcgactccgccgagggccgctcgccgatgaaccggtaccgggtcaaccggatcacctccgagaccggctccaacaccgacgtcaagtacaccgacatcgactgcgtcgccggcgcccttccagccccggacagcaacaccaggcgctgctacccgtcctggtggacacccgagggcggagccgaaccggtcttcgactggtttcacaagtacctcgtggagaaggtcaccgaacacgacctcgtggccggctccggatcccccgacaaggtcaccgcctacgagtacctcgacggggccgcctggcggcgcgacaactccgagttcaccccggacaaggagcgcacctggaacgacttccgcggctaccagcgggtccgcacccgtatcggcgactccggcaagagcctgaccgagaccgtctacttccgcggcatggacggcgacactctcgccaacggccagccccgccccgtcagcccgctccagggcgtcaaggacagcaacgaactcaccggcttcgcccgcgagagcatcgtctacgacaaggacgacaaggacggcggcaagcccgtcaccagcacggtgaacaacccctggctgcgcagcaccgcgagccgggccgtgaaggccttgcccagcaaggacaacaagaccgctaccccgccggccgagaaggatcggcctgaggtagcggtcctgcccccggtgaccgccacgatggtccgcaccgagagcgtgaccaccaacgcgttccagccggacggcagcacggcccgcacgctccgtgagagccgcaccttcgacagttacggccagaccacggcggtctccgacgagggcgacacgaacgtcaccggtgacgagcagtgcacccgcaccacctacgtcaccccggacaccaccaactggctcatctcctacccacggtccgtccagaccaccagcaccctctgctcgacgaacgccacacccgcgaccgtcacgagcgaagccaggacggcctacgacagcaagcctctcggatccgcgcccgaaccgggcaagggctatgccaccacgacggaagcccttgaccgctacgacggcaccaccccgcactacctgacggtcagcaccaccgcgtacgaccagtacgggcgagccacctccgtcaaggacgtcaacagcgcggagaccacgacgtcctacaccccggcgagcggtagccaggccaccgtcgtccagtccaccaaccccaagaagttcacgaccaccaccaccaatgatggcctgcgtgccctgccggtgaaggtcgtcgacgccaacaaccgcaccacccacgtcgactacgacgccctcggccgcaccacggccgtgtggaacccgggccgggacaagaacgcctcgcccaacgtgacctacgcgtacaccgtcgagcccggcaagcagcccgccgtcacgaccaggaccctcctggagaacggcgactaccgcaccagcatcgccctgtacgacggcctgctccgcccgcgccaggtccaggacgaggcctacggtggcagcgaggcccacaacggcggccgcaacatcaccgacagcttctacgacagccacggccgcatctaccgcaccaacgctgcctaccactccaccggcactccggaagcggcactgtggatcggcctggacaacaaggtcccgtctcagacggagaccgagttcgacggcctcgaccggccaaccgccagcatcttcaagtcccagaacaaggagcagtggcgcaccaccacccggtacggcgtgaactggggcgcgaccactccgcccgggggcggaactcccacgctcaccatcaccgacgctcatgggcgcacctccgaggtgcggcagtacaagagtggtagcccggacttcggcgccgacgcctccgcttacgagacgctgaagtacacctacaacccggcaggcaagctcaccaggttcaccgacgccgcaggcaacgcctggacctgggagtacgacctgctcggtcgtcagaccaaggcggtcgacccggacaggggcaccaccaccagcagctacaacgcggacggcaccctggccaccgtcactgacgcccgcggcaggacgctcgcctacacctacgacgtcctcggccgcaagacggggatgttcgacggctccacgacaggcccgaagctggccgagtgggccttcgacaccctgcccggcagcaacggcctggccaccggcagcacccgctgggagaacggcaaggcgtacaccagcggcatcaccggattcgacggcgcggcccggcctttgggcagtaccgtcaccatcccggacagcgagggagccctcgccggcacctacaccaccgcccagacctacacccccaacaccggcctgggggacaccacgacctacccggccggaggtggacttcgacaggagagcatccaccgcgactacaccctgctgggcctgcccacattcgtcaccgacggcggcaaccaggtctactcccagggcaacacgtacaacgaatacggccagatcacgcagagcagcatcggccgcttcggctccggcgcctaccagacctacgtctacgaggagcacaccaagcgcctcgcgcaggcccggaccgacggctattccaaaccgcagaccctcaacaacaagacctacacctacaaccagatcggcaacatcacccaggtccgcgacgcccgcggtaaccccgctgtcacggacacccagtgctacacgtacgacttcgcccagcgcctgagcaacgcctggtcggcgaccgacaactgcgtcgcccaaccgaccccgaccactgacccctacgtcggcggagtcgacccgtactggaccaactacacctacgacgcggccggcaaccgcacccaggccaccaaccgcacctccggtgccgcccccggtccgctgatggacaccaccaaggtgacctctgtcgccatcgcgggtgacggccagaccagcgccgtcgcaatcgccgacggccaggtctacctctcccaacagcgtgccgatggtacgtgggccaacttcgagaacctgcacaggacccaggcagggcctctgcccgcccccgtcgactacgtcgcggcggcctgggccgacaacaccctgcagatcatggccgtcgccggcggcaggatctggcacaccctgcgcggcgccgacggcaagtggggagggtggggcgacgtcaccagcgtggtcgggtccatcgccaaccccagccagctctccctgtccgccaccgcctccggactggaggtcctcgccctctccgacggcgtgctcaagcacaccctgcgcaagcccgacggcaactggtcgacctggggcagcgtctacagcgagaccggcagcctcaccggagccacccgcgtcaccagcgcggccaccagcaccggcctcgaagtcatcgtgatcgcgggagacaagctctggcacaccgtccgctaccccaatgccagctggtcgaagtggggagacgtctacagcgtcaacggcgcactcacctcgcccaccaacctcgccgcgaccgcgaccgccgccggcctggaaaccgccgtcatcgccggcgggaacatctggcacaccctgcgcaagcccgacggcaactggacgagctggggcaacgtcagcctggtcgtcggcccactcagccagcccacctccgccgctgtcgtcagttccttgggcgacctcaagctcatcaccgtcgccggaggaaccctcaactacaccaagcgttcctcctccaccggaaactgggccccctggagctcactcacccagacgcccgagaacccgcagacgagccagaaccagcgcacctccacctaccccgcacccggaggcacccgaccccacgccctctcccgcgtcgacatcaccggcaccggcgcccgcaccgacaccttcacctatgacgacgctggcaacaccgtccgccgcgtcaccgccgacggcgaccaagccctcgaatgggacaccgagggccacctcaccaagtccaccaccgcgggaaaaagcacgaccttcctctacgacgccaacggcaaccgcctgctgcgccgtgagcccgacgcggtgaccctctacctggacggccaggaactcaagctcgacaagaccgccaacaaggtcatcggcacccgctacatcaccgtcgccggcgccaccatcgtcaaggcctccgacggcaccctcaactacctcatcaacgaccaccaggggaccgcccaactcaccatcagcgccgacaacctctacacccgaggcgacaccacccccttcggcactccacgaggcaggaaacccgcctcctggcccaccgaacgaggcttcgtcggcggtaccaacgacgccaccaccggcctcacccacctcggagcccgcgactacgacgcggccaacggtcgcttcatctcggtggacccggtcctcgacctcaccgacccgcaacagatcaacggctacgcctacagcaacaacaacccggtcaacctcaccgacccgagcggacagcgcccagagggaatctgcggtggattcggcacgtgttacgactccaagggaaatataaacaccgaaacgttcaagcgtgaggacgacggtacctatacggagaactactggaaccactggagcggaagcaaggagaaccccaatgtcgtaagcccgcacatgcacatcatctaccgtggcggatcgctcaagcagaacgtccacgggatgttcgactcgattcagtacatccccggtgtgagtgccattggcgctgtcggatctgccgtcatggacgccgctgacggtcactacatgagcgcggcccagaatctcgcgggggccatccccggtgagcgcctcttcgcgatggccggaaaggccgggaaagccgccatggcggcagaccgggccgaagacgtgggcaatgcgactgccgacgccttgtcgatcctctcgtgcgatggtgcccaagcgggcgccatgcacagtttcccaccaggcacacgtgttctcctggccgacgggacgacccagacgatcgaatccctccagctcggagaccaggtccaggcaacggacccgacaaccggagaaactgagtccaagtcggtcatccgcaccatccggacacccgatgacgagcacttcaccgacctgcaactccaggtcaacgcctccgacggtgaacccggagcagtagagaccctcaccagcacccagcaccacccgttctgggacgagaccacccaccagtggaccaacgccgccgaactcacccctggcgacaccgtccgcaccgtagacggccgcacccccaccgtcctggcagtaaggaactacgacaccgccccccaggtcgcctacgacctcaccatcgccgacctccacacgtactatgtgctcgcaggggcgacgccggttctcgtccacaactgcggcgagccgcgtttcagcgtgggatcggatggcgttgtcgaggacctagccaatccattgccggtgcgtggcggctatgtgcctgttccgaagcttgacggagggaccgttcctggcgtcggcaacaagatctgggggaacagcgatcctgagcatctcattggcacccgctcgccggaggcgcttcgcggaattgccagcaaggcggacgcaggaaaactccaggatttctacgccggagctgccaatgccggcaagggcggcgcgtctgggcgggggtcgcagaactccaggaacccagtggatacggcgaggaaccgcgtgaccctactacaggaaatcatcgacgcttggagctga

SEQ ID NO: 30 - DNA, 2181 bp, Streptomyces Sp.
atgggacaccggagcaccgagcttcgccggcgcaagcgccgcaggctcacccgcaggagcgccctggtcgccgcggcggtggcggcagggctgctggcgggaacgctcggcatccgcaccgcgctggagccggcggccctgaacggcgccgtcacggccgcggccgacggggtcgacggttcggggacgcaggccgggctggtcggctacgacggcgcaccgggggagaccggcaccgccgaaggggccacccaggtgcccgccccgaagcgggaccagaaggccgcgccgctcaaggcgatacccaaggacgagcccgaacgcggcctggtctacgccggattgagcctgccgggcagcgaccgctgcggcggcacgctggaggtcaccggcagcacccagtgcagccacggcccggacgtgccgcccaagggcgtggacatccgccaggacgtcccgccggtcgcggccccggtcgctcggacgcccgcgctcacccccgcggccggagcccaggcacccgccgccgccgacctgctgaagggctccgcgcccgtcctggacgccacgcagaaggcactgctcggtggcgccggcaccgccgcggacgccgcccgggccggagcggacgcgcccgccgggtccaagctggtctgcgagggcgacggcagcagcggcaaccgcgtccaggtggtgtacgtccacagcccgggcaacgaccgcttcgcccagtacctcgcctcgttcaagaagtgggccgccgacgtcgacgtcatctacaacgccagcgccgcggagaccggcggcgaacggcacgtccgcttcgtcaccgagtccgactgcagcgcctcggtgctgaacgtgcagatctccgacgccgagatccaggacttcaacgcgagcaaccgggccctcgccgcgcaggggttcaaccgcaaggaccgcaagtacatgatgttcaccgacgccaaggtgtactgcgggatcggcaccttcgccggcgacgagcgccccggccaggacaacctgagcaacttcggtccctcgtacggccgaaccgactccgggtgctggagcggcagcaccgccgcccacgaactcggccacaacctgggcgcggtgaacaacagcgtacccaactccagcaaggccgggcactgcgtcgacgagtgggacgtgatgtgctactcggacgcccccgactacccgcagatgcggaccgtctgcccggaccgcgcccatgacgaccggctcgactgcaaccacgacgactactacaacacctcaccgtcgccgggcagttacctcaccacgcactggaacgtcgccaacaaccgcttcctcgtcgccggtggcggcagtggccccgacccgacgcccaccccgactccgaccggcacgccgacccgcacgccctcgccgtcccctacgcccaccggcagcaccacccccacgccgaccggctccccgtcgccgaccgcgaccccgaccgcgaccccgactgcgacccccactccgaccgcgacccccacggcgggcaacaccggccccgcggtggccgtcagccaggtcacccagaactccgccgtgctcagctggaccgccgcacccgccgcggccggctacgacgtcctgctgaacggccaggcgatcggcaccgtccgctcgacggtggtcggcgtggtccgcctcgcccccggcacctcgtacaccgtggccgtggccgtccgcgacgccgccggagcggtcggcaagcccggtcgcaccgccaccttccgcacggtcaccgacaccggccgcccgcagccgggcacgcgctacacgatggtcaacggactgaccgggcaggccgccgacctgtggggcagctcgatgaacgacgggaccgtggccatcgcctaccagcgcaccggctacgccaaccagaagtggcagttcgaggacgccgggaacggcgcggtgcggatcaagtccgcgcgctccggcaagtgcctgcagctcggcggcgccccggtggccggtcagtacgtcgcccagcagccgtgctccgacacggccgcgcagaagtggcagctcaacgccgtcgagggcgggttcaccgtcaccgcggacggcggctcgctcgtgctggggctcagcactcgctggtactacggcggttggctgctggagctgcagtag

SEQ ID NO: 31 - DNA, 954 bp, Streptomyces Sp.
gtgagcaccgccgagaccgacctcgtcgagacgcccgccgccgacccgcgggtggaggtcctgcccgcccgggacgtcccgctcggcggcccgcgcgcgatgaccgtacgccgcaccctcccgcagcgctcccgcaccatgatcggcgcctggtgcttcgtcgaccactacgggcccgacgacgtcgccggcaccggcggcatggacgtcgccccgcacccccacaccgggctgcagaccgtgagctggctgttcaccggcgagatcgagcaccgcgacagcctcggcgtccacgcgtacgtccggccgggcgaggtcaacctgatgacctccggccgcggcatcgcccactccgaggtctccaccccggccaccaccgtcctgcacggcgtgcagctgtggatcgccctgcccgaggagcaccggcacacggggcgcgacttccgccaccacgcccccgccccggtcaccctggacggcggcgaggcacgggtcttcctcggcaccctcgccggcgacacctcccccgtccccaccttcaccccgctgctcggtgccgagctgaccctgcgcccgcacgccgtcgtcaccctcgacgtcgaccccgccttcgagcacggcctgctcgtcgacaacggcgaggtccgcctcctcgacaccccgctgcgccccgccgaactcggctacgtcgcccccggccgccgcacgctcaccctcaccaacaccggcgcgaccgacgcccggctggtgctgctcggcggcacgccgttcgaggagcggatcgtcatgtggtggaacttcatcgggcggtcccacgaggacatcgcccgggcccgcgaggagtggcaggccgcctccgaccgcttcggcaccgtccagggctacccgggcgaccgcctccccgccccggaactcccgggagtccccctcaagccccgcggaaacgtgcgctga

SEQ ID NO: 32 - DNA, 7470 bp, Streptomyces Sp.
atgtatcccttcgacacgggcgccccacccggagcgaaaaagcgtcgctccggggcgataacacgccctctgctccttagagccgcgcccatcgccgcgacggcgctgatcgccgccgtcgtacaggtcccggtcatcgcggcagcggccgacggcgagttcaagctcccgtccgtccagcacatcgagtcggtcccgttgtcccgcgtcacgggagaccgcccggacacgggggccgcccagcccccgacggcaccgccggcctcggcatggcccaagccgggcaagaccgagatcgaccttccggcggtctcggcgcagcagccgtcgtcccaggcgaaggcccccggtctgccgctgaccgtctcgtccgtcgggccgaccccggcggcgggtgagccgtccaaggtccgggtaggcctgtccgaccgcgccgccgctgccaccgtgggcctcgacgggctcctggtcaacctggagccggtggcgggcagcgccgcaccggacaaggcacgtgtccagctggactacaaggccttccgcgagtccttcggggccgactggggttcgcgtctgaccttcgtgcagctgccggcgtgtgcgctgacgacgccggaccagccgcagtgccgctcggccacgccgctggcggcgtcgaacgacaccaaggcggggaccctgacggcggaggtcgcggtgtccgcacccgccggccaggtctccgcggacggtcaggcttcctccggcggtacggtcaaggcgtccttcacccaggcctccgaggcgtcggccgccgcagcgacagtactggccgccacggccggggcctcgggcccggaaggcgactacaaggcgacctcgctctccccgtccagcacctggtcggtgaccggcaacaccggatccttcacctggtcctatcccatccaggtacccccggtgcccggcggcatggcccccaagatcgccctcggctacacctcggcggccatcgacgggcgcaccgcctccaccaacaaccagtcctcctggatcggcgacggctgggactacaaccccggcttcatcgaacgcaactacaccccgtgcgtgggcgacaccggcccgggcagcaacgccccggccaccagcggtgacctgtgctggaagtccgacaacgccacgatctcgctcaacggcaacgcctccgcgctggtgcgcgacgacgccagcggcacgtggaagctgtccaacgacgacggctcgcgcgtcgagaagctcaacggcaacacgacggacaccgccaacggcgacaccgacaacgagtactggaaggtcaccacgaccgacggcacccagtacctcttcggcaagaaccgcctgcccggctggacgacgggcaagcccgagaccggctcggccctgaccgtgcccgtcttcggcaaccagcccggcgagcccggctacgccccggcgttcaaggactcctcgcgcgaccgggcctggcgttggcagctcgactatgtcgtcgacccgcacggcaacgcgatcgcgtacttctacggccaggagaagaacgcctacgccaagaacatcggcgccgccaccggcacccccaaggccgacgcgctctacacccgtgccgtcacgttgaaccgcatcgagtacggccaccgggccggccaggtctacaacactcctcccgcggggaaggtcaccttctccaccgcggaccggtgcgtggcggccgactgctccttcaccaaggccaacgccggcaactggtacgacaccccggtcgaccagtcctgcgacaaggaccaggactgccgcaacggcgccccgaccttctggtccaagaagcgcgtgacaggtatcagcacgcaggccctgcagagcaacggcagctaccgggacatcgacgcctggagcctggaccaggacttccccgccaccggtgacagcggtggccgggcgctgtggctgaagaccatcacccgcaccgccaaggccggcgccgccgcacagacgctccagcccgtgaccttcggcggggacctgcgccccaaccgggtcgactccgccgagggccgcccgccgatgaaccggtaccgggtcaaccggatcacctccgagaccggctccaacaccgacatcaagtacaccgacatcgactgcgtcgccggcgccctgcccgccccggacagcaacaccagacgctgctacccgtcctggtggacacccgagggcgcggtcgacccggtcctcgactggttccacaagtacctcgtggacacggtcaccgaacacgacatggtcgccggttccggatcccccgacaaggtcaccggctacgagtacctcgacggggccgcctggcggcgcgacaactccgagttcaccccggacaaggagcgcacctggaacgacttccgcggctaccagcgggtccgcacccgcgtcggcgcctccgacaagagcctggccgagaccgtctacttccgcggcatggacggcgacaccctcgccaacggccaaccccgccccgccagcccgctccaaggcgtcaaggacagcaacgaactcgccggctacgtccgtgagagcaccgtctacgacaaggacggcggcaagcccctcaccagcacggcgagtaccccgtgggtccgaggcaccgcgagccgggcgacgaaggccctgcccagccaggacggcaagcccaccgcgaccccgccgggtgagtccggcaggccccaggtcgcggccctgccgccgctgaccgccgcgatggtccgtaccgagagcgagaccaccaaggcgttccagccggacggcggcaccgcccgaaccacccgcctgagccgcaccttcgacgactacggtcagatcagaaccgtttccgacgagggcgacacgaacatctccggcgacgagcagtgcacccgcaccgcctacgtcacccaggacaccgccaactggctcatcgcctacccgcagtccgtccagatcaccagcacactctgctcgacgaacgccacagcggcgaccgtcacgagcgagaccaggacggcctacgacggccggcccgtggggaccgctccggaaccgggcaagggctacgccaccacggtgcaggccctggaccgctacgacggcgccaccccgcattacttgacggccaccaccaccgcgtacgaccagtacgggcgggtgatatccgtcaagggcgccaacaacgccgagaccacgacctcgtacacccccgcgggcggctcccagccgacgctcgtccagtcgaccaacgccaagaagttcacgaccaccaccgcctacgacggcctgcgagccctcccggtgaaggtcatcgacgccaacaaccgcaccatccacgtcgactacgacgcgatggggcgcaccacggccgtgtggaacgccggccgggacaagagcgcctcgcccagtgcgacctacacgtacaccatcgagccgggcaggcagcccgccgtcacgaccaggaccctgctggaaggcggcgactaccacaccagcatcgccctgtacgacggcctgctgcgcccgcgtcaggtccaggacgaggcccacggcggcagcaccgcccacaacggcggccgcaacatcaccgacagcttctacgacagccacggccgcgcctaccgcgccaacgcggcgtaccatgccgacggtgccccggaagcggcgctgtggatcggcctggacaacaaggtcccgtcccagacggagaccgagttcgacggcctcgaccgtccgaccgccagcatcttcaagtccctgaacgtggagaagtggcgcaccgtcacgcgctacggcctgaactgggtggcgacgaccccgcccgacgccggcacttccacactcaccgtcgccgacgcccatgggcgtccttccgaggtgcggcactacaagaccgggagccccgactacgacgctcccgcctccgcctacgagacgctgaagtacacgtacgactccgccggcaagctcgcgaagctcgtcgatcctgccggcaacgcctggacctgggagtacgacctgctcggccgtcagaccaagactgtcgacccggacaagggcaccaccaccagcgcctacaacgccgacggcaccctggccaccgtcaccgacgcccggggcaggacactcgcctacacctatgacgtcctcggccgcaggacggggatgttcgacggctccacgagcggaaccaagctggccgagtgggccttcgacagcctgcccggcagcaacggcctggccaccggcagcactcgcttcgagaacggcaaggcgtacatcaccggcatcaccgggttcgacggtgcggcccggcccaccggaaccaccgtcaccatcccggacagcgagggactcctcgccggtacctacaccgccgcccagacctacacccccaacaccggcctggtggacaacaccacctacccggccggtggcggactcccgcaggagaccgtccgccgtaactacaccccgctgggattgcccaccacggtgagcggcggcagccgggtgtactccctcggcaacacctactcgccgctggggcagctccagcagagcgtcaccggtgacatcgggtccagggcggtccagacctacgactacgagaacgcgacccagcgcctcgcggtcgtccagaccgaccgggagcgcagcggaccgcagaccctcgaaaagaagacctacacctacaacccggtcggcaacatcacccgggtccgcgacgcccgcgacaacgctgccgtcacggacacccagtgctacacgtacgacttcgcccagcgcctgaccaacgcctggtcggcgaccgacgactgcgtcgccaagccgaccccgaccaccgacccctacgtcggcggcgtggacccgtactggaccagctacacctacgacgcggccggcaaccggacccaggcgaccgaccgcaccttcggtgccgcccccggcccgctgatggacaccaccaaggtgacctccgtcgccatcgccggtgacggccagaccaccgccgtcgcgatcgccgacggccaggtccacatcgcccagcagcgtaccgacggcacctgggccaacttcgagaacctgcacagaacccaggcagggtccctgcccgcgcccgtcgactacgtcgcggcggcctgggccgacaacaccttgcagatcatggccgtcgccggcggcaggatctggcacaccctgcgcggcgccgacggcagatggggagcttggggcgacgtcaccagcgtcgtcgggtccatcgccaaccccagccagctctccctgtccgccaccgcctcaggcctggaggtcctcgccctctccgacggcgtactcaagcacaccctgcgcaagcccgacggcaactggtcgacctggggcaacgtctacggcgaaaccggcagcctcaccggagccacccgcgtcaccagcgcggccaccggcaccggactcgaagtcatcgtgaccgcgggcgacaagctctggcacaccgtccgcttccccggcggcacctggcagaagtggggcgacgtctacagcgccaccggaacgctcggctcgcccaccggcatcaccgccaccgccaccggcgccggcctcgaagtcgccgccatcgttggcggaagcatctggcacaccgtccgcaagcccgacggcaactggtcgacctggggcaacgtcagccaggtcctcggccggctcgaccagcccacgtccgccgcggtcgtcagctcgggcggagacctgaagctcatcacgatcgccgcaggatccctcaactacaccaagcgggcctacgccaccggcagctggctgccctgggcgcagctcacccagacccccgagaacccgccgagcgaccagatccagcgcacctccacctaccccgcccccggaggcacccgaccccacgccctctcccgtgtcgacatcaccggcatcggcgcccggaccgacaccttcacctacgacgaggccggcaacaccgtccgtcgcgtcaccgccgacggcgaccagaccctcgactgggacatcgagggccacctcgccaagtccaccaccgcgggaaagagcacgaccttcctctacgacgccaacggcaaccgcctgctgcgccgtgagcccgacgcggtgaccctctatctggacggccaggaactcaagctcgacagggccgccaacaaggtcaccggcacccgctacatcaccgcaggccccgtcaccatcgtcaaggcctccgacggcagcctcaactacctcatcaacgaccagcaggggagcgcccaactcgccatcagcgccgacaacctcgactacacccggggcgacaccacccccttcggcaccccccggggcaggaaaccggcctcctggcccaccgagcgaggcttcgtcggcggcaccaacgacgccaccaccggcctcacccacctcggagcccgcgactacgacgcggccaacggccgcttcatctcggtggacccggtcctcgaccccaccgacccgcaacagatcaacggctacacctacagcaacaacaaccccgtcaacctctccgaccccagcggattgcgcccggagggcacctgcggcggcttcggcgcctgccagaccccgaccggcgagaaggtccaggaggtctggacctcggaccacggtgtgtggaccgacaccatcaccaagacccgaccgccctaccagccccctgcgcagaacacgagctccggcatccccggcctcaagaagccggcgccgcaaacggcccagccggacgacgcctgcgggtcgaaggcggtctgcgccatggccgacaaggttgacgatgccatgcggctttgtgccgagatcggttgcggggtctacagcgtgacgaactacccccgtaacaacgacagctcgcacgacgtcctccgtgcgtggctgctcaacgcctgggacaaccccgacgtggtgaacttcggtgcgggtgatccgctgctgatggaccttgccaagacggacgaggttcaggtccttatggagatgctgctcacgaactacaaggagaagggggccaaggcgatcggcgagcctctcaggaaccagtatgaggacaatggccccctgggcactgcctggctcggcatccccgccgatgtcctcggctctctgaccaacggggcgatcggcgccgacgaagccaaagcagtcatcggatcgttcgtcgtgcacggcacgatcgacagcgttcaatcggcgagggacggatatcaggtggtgaacatgcacttcacggtcgtcaacaactggaactggaactcggcgaccaagatgctgccggccgactggtacccgacgatcccgaccgcatccggcgtggggtggacgcccggtaagccgatagacgggcacttcgagtggggatttcggagcttcgtcggcccgagcgggggctga

SEQ ID NO: 33 - DNA, 348 bp, Streptomyces Sp.
atgtcgcagcacgcaccggacgggaccgagggacagacgctgccgttctgggtcgacgtcgtggaggaagagggcgacgaaggcaacgccatgggcggcctcttccggcacgacggcgagaccgtcctgcgctcggtccccctcggccccctccgcaagaatctcgccgacacggtcgacgccctccagaaggtcttcgaggaggtcgccgaccgcggcggcgcgctcccgctcgccgaggcccagctctccttccaggtcaccgccaccggcggcatccagctcatcggcagtggccaggtgcaggggacccgcggtctgactctgacgttcaagcgcccgtcgtag

SEQ ID NO: 34 - DNA, 621 bp, Bacillus Sp.
atgaaaggtttagtaaaagctgcagttttaactgttactcttggtattggaggcgctttctattcaagtgatgcatctgcacacgggtatataaaagagcccgtcagcagagcgtacatgggagcattagagaaacaaacattgggctggacggccgctgcgcagaaatatggctccgtcattgataatcctcagtctgtagaagggccgaaaggatttccggctgcaggtccgccggatggaagaatcgcgtctgcaaatgggggatcgggacaaattgacttcggtttagacaagcagactgcagattattgggtgaaacaaaacatccgcggcggttttaacacctttacttggtactacacggcccctcatgcgacatcaaagtggcactattatatcaccaagaaaaactggaatccgaataaacctttgtcaagagatgaattcgaattaatcggaacggtaaaccacgacggttccaaggcagatacgaatctgactcataagatttttgtgccgactgatcgaagcgggtatcatgtcattttaggggtatgggacgttgcggatacttccaatgccttctataacgtcatcgatgtaaaccttacacaataa

SEQ ID NO: 35 - DNA, 6177 bp, Streptomyces Sp.
atgcaagggctgagcgggcggatacgccgcccgggcggacgccggaccctgggtcaatcgctgcgcgcagtcgcggccacgcttgccacggttctcctggccacgatgctggccgtcctgaacgggcccactgctgccgccgccgaaaacccctgggtgccgccgcagcaactcgccggcgagcggaacatcatcacctggaacatgcaggggtcgaccgcggtcgagacgggcagcacgtacgaacggctcaaccagctgtacagtcgagccgtcgccgacgccgcccgcggtgccggcctcgtcgagcagaaacgcgtcgtgatggcgctgcaggaggcgggtgtcccgcccacgtcctgggctccgctccaagccgccgagttgccgaacctcgtcgtccccgacggagtgcggggctacaagcggcgagtgggacgggactacacctatctgttccacgcgcagaccatcggcgacgaccccgccggacgtgtcaactcggcgatcatgaccaacgaactgccccggcgcctggtctacatccccgctgtggccgggacgctgcgccccctgatcggtgtgggctacggcgaggaccgtgcgaacggggagtactacttctccttccacgcctcctccgggaacggcggccgcgacatcgtgcccatgctccggcgcctggtggccgagatgggtcggctggaagcggacgagcatgaagggcatgcggtcaactggtacgtcggcggcgacttcaacctggacccgaccaccctcagggatcgtcttgacggtcccgaagtcaatgggcaggacgtccacatcgccaggccggagcgatacacccatcgaagtcccgacgggaccacaagcatgctggactacgtcgtcaccaacgacccgtcgatgtccgatgtgctggggagggtgacggatcagacgggctacgccgaccacgacaccgtctactacggacggcggatcggtggcggagcgccctgcgccaggccaagggtggcagggctggaggcggccgcaccggaggcgtcggccgatccctgcccgcttccccgcccgggcgcgatcgtgtccatgggcgacagctacatctccggtgagggcggccgctgggcgggcaacgcgctcaccaagcaggagggggacgtctggggtacggaccggcgctccaagtgcccggacggctcgcaggactgcgtgtacggcgcgacgtcctacgacaacaagggcaaccggtgcgaccgttccgacgtcgcccccatcaagggcgcggagttcgaggacatccccgtcgagcggcggctcaacatcgcctgttcgggcgcgacgacgaaggacatcctcacggagtcgcgcaacaacgagaagccccagatccagcagttggccgacctcgcccgcacgtacgacatccggatggtcgtcgtgtccatcggcggcaacgacctcgacttcagcgggatcgtctcggactgtgcgaaggcctactaccgctgggtggagatctgctccgcacccaacaaggcggcgagggtcgcccgctcggtcgacgccgtgcaagcggagatcgtcaagacgctcgctgcgatccggagcaccatgaccgcagccggtcagtcgggctaccagttggtgctccagtcctatccgaacccgattcccgccgcggacaacttccgctacccgttcgacggtacctccgacccgcgcttccgccagggtggctgcccgttcaccgaccccgacgccgactgggcccacagcacgctggtcccgaagatcagcgacatgctgcgccgggccgccgggaccgccggcgcgaagttcctggacgtccaggacgccttcgcggggcacgagttgtgcgcgaagggagccgagcaggcgacggaggcgaacagcaacgcgagtccgttgcccgcgtcgaaggccgagtgggttcgctgggtcccgtacatcccgaatctcgggtggctgacgcccaacgcgcagggtgacgtccaggaggccatccacccgaacgccttcgggcagcaggccctgtcgcagtgtctgaccgggttcgggaaggaggcgccggcctccgaccggtacatcttcacctgcacgggttcgggcgacggcatgaaggtcgtaccggacggttccgcggtgcgtgagggcatcgtccggctgcgcaacgccgagacgggcgaggtgctggacgcccaggggaacggcacggacgactacctcgtcacccgtcccgacaaggcggaggccagccagcggtggctgctccgcaacgtgggcgagaaggtgacgctgcaggcgcagcacaacgggcgctacctgaacctgtggcaccacctcctcagcggccggaactgggccgccctgggcgacaaggagaccggctggttccactcggcgagggaggacgggcgggtcgcgctgtccctggacgatgtcgacatgaccaccggctgcctcacccaggacccggggaggcggtccgaggacacgaactgggtcggcgtcgactcctgcggccaaggcgtcaagaaggagcagtactggtacatcgattaccccgacgacgtggtcatcaccccccgccaacccgacgccggcacggatccgcgcgagggccagcaggtggagctgcgctcggccgccggcacggccgtgcacctgagcggtggcagcaccgaggccgggacgagcgtccaggccgcggaacccgacggcagcggtgcccagcgctgggtgatgcgctcgctcggcggcggcaactggcggatcgcggcctcggcgaagccggacatggtcgtggaccacaatcccgggccgcacaccactcacctcgtgcaggcggaggagggcaacgccaaccaggtctggcagccgaagggcgccggcggcggctggtacaccctggtcagcagtgccgacggcggctgcctgaccggcggcggcgcgggcgaggcgctcgcggtgacggcctgtgacgcgaacaaccaggcccagcggtggaagttccgggagaccgggacgggcacgcaggtgggtacgatccgcgggctggagggcaagtgcgtggagccgcgcggcggcagccgggacgaccggaccccggtcgcgctcgcggactgcgccgggtccgacgcccaggcctggacggtgtcggacgacggctctctgcagtcgctggccaagtgcctgcaggtggacggcgggcgcgccgacaacaggacggccgtccagctgtacacgtgcaacggttcccccgcccagaagtggatctacaccgcgcggcaggaactgcggaacccgaactcgggcaagtgcctggacgtccccgactcggacacctcccggccgttgcagatctacgactgcaaccgccgcgactcccagaagtggcagctgtccgcccgcccggtgggccagcccgacgggggtgacgcgggcgacccgttcgacgccgccccggacgatcgcggcaccaagccggccgcttcgggggactgccgtcccgagggcatggccgtcaccccgggcgtggccgcccggtactgcgacgtgtacgacggcgcgggccgcgagtgggtcggcaacaaccgcacccggcgggtggtgggctacttcaccggctggcgcgcgggcgcgagcggcgacccgaagtacctggcgtcgaacatcccctggtcgaaggtcacgcacgtcaactacgcgttcgccgaggtgcgggacaaccggatcagcatcggcgacccgaacgacccggccaacccggcgaccggcatgacctggccgggcgagaagaacgccatggacgcctcgctgccgtacaaggggcacttcaacctgctgaacacgtacaagaagaagcacccggcggtgaagacgctgatctcggtcggcggctgggcgggcacccggaacttctacgcgatgaccaccaacgccgacgggtcggtgaaccaggccggcatcgacgcgttcgcggactccgtcaccgacttcctggaccggtacgggttcaacggcgtcgacatcgactacgagtacccgaccgcgctgcccgacaccggcaacccgctggactgggacgtctccaacccccgccgcaaggggctccagcagggctacaacgccctgatgaagtcgctgcgggagcggctggaccgggccggcacggacaagggccgctactacctgctgacgtccgcgggctcctcctccggctacctggtgcgagggctggacgccggacaggcactgcagtaccaggactacgtcgacgtcatgacctacgacctgcacggctcctggaacaggttcgtcggcccgcaggccccgctgtacgacgacggacgcgacaacgagctggcggacgccggcatctacaacgaccaggcgcccgacaccaaggacttccaaaaggagggctacttcaacgtcgactgggcctaccactactaccgcggcgcgctgccggccggccggatcaacctcggcatcccgtactactcccgcggctggcgcgacgtccagggcggcacggacgggctgtggggaacggccgcgatgccggaccaggcccagtgcccgctgggcaccggcgggcgcggcccggccaacgcgcagtcctgcgggacgggcgcggtcgggatcgacaacgtctggcacgacctggagaacgagcgggaggtcggcgccgggtcgaacccgctgtggcacaccaagaacctccaggacggccggacccccggctatctgcggtcctacggcgtcgacaccaacctgccgagcggacagctgaccggcacgtacgcggagaagtactcggacgccctccagtcgccgtggttgtggaacgacgccaagaaggtgttcctctccaccgagaacgagaagtcgctcgacgccaaggcccgctacatcgtcgacaagggcatcggcggcgcgatgatctgggaactcgccggagactacgcccaacgcccgggcggggagtggggcatgggctacgacctgaccacccgcctggacaacgccttcaagggcgccggcgccaccggcaacaccaaggccggggggcggccgcagccggccgaggtgatcgacgtcaaggccgaactggtggacttccccaccggggagaaggacttctaccccgtccagccgaagctgcggatcaccaacaactccggcgtcacgctcgcccagggcaccgagatcgccctcgacctgcccacctcgatgccgccggtcgtcaaggacaacgactacaaggagatgaagggcctcgtccccggccacaccggccccaacacgggcggactcaagggggacttccaccggctcaccctcaccctcggctactgcgaggacctggcgccgggcaagtcccgggacatcgacctgaagtactacctgccgatcaccgggccgtccaacgtgacgttcaggatcggcggccgggagtacggctcgaccggtgaccagcgccgcgacgtccggaccgtcacaccgcccgcccccgccgcgggcagctcctgccaggcaccggactggaagcagggccaggtctaccggcccgacggcggacggctgtggcggatgtacgacaagggggacaagggctggatgttcgagtacggcgacagccccgccggcaagcccatgatgatcgacaacaaccccgaccagtcccgcgcccacctcgtggaactgatggaacagaacgccaaccagtactggcggatccagccggcgggcggcggcctctacacgatcgccggcggcggccggtgtctgaccgccaccgcctcccggcaggacctcgcctccgtggggtgcgacgggcggcccgaacagaagtggcggctcgtcccgatcgccgacaacggcagtgagggagcacccggcgggccgaagcacaacggcctgttcaagctccgctcggccgcgggcagcgacatcgaactcgccggcggcgccaccgcccgggagacccacctgctcaccggcgacccggccgcctcgacggccgcgttcgtgaagtaccagggctcctactggtacgcccagtggtacaccacggtcgcccccggcacggcggaggcgaacggcggccggccgtggaagaagctcagcccggcgccgtag

SEQ ID NO: 36 - DNA, 2871 bp, Stenotrophomonas Sp.
atgaagtattcgaagttgagcctggccctggccgggctgatgggcgttgccgccatatccgtggtggatgacgtcatggcaatgaattatcacgtgcagggcgatcgcatcttcctgagtggcgatgtgacctacgccgacgtggtgtccctgccggcactgctggccaaggcgcaggccgaaggccggccggtccgtgaggtggtgctgcgcacgtccaatggcggtgcgttgatcgccggcgagtggctgcagggcatcatccgcacctccggactgaacaccatcgtgtccggcaattgcatctcgtcctgctcgatcatgcagtccggtggcgtcgaacgctatctggccggcgatctgccgctcatcgactcggtgcagatccacgcggccagcagcggcggcaaggtgatctacacgccgtcaccgcgcatgacccagatctataccggcaactacggtggtggcatggatgccgggctgctgcacaaggccatgtacgaagtggtgaagccgaacggcctgctggtgttccgcgatccggcacgcagcaccggttcctcggtcaccttcgaccccgatggcagtggcagcaagctggagtcgttccccggccaggacatctacagcaacaggatcatcaccgcgaacgggtaccgcgatccgggcgacaccttgaatgtcaccgccaacgtgaccggcgacatcaacccaggctacctgcgtaccggacgccagttgcaggcgttcgtcgatgatgatttcgcgcgctggaataccgactggcgatccacctacatcaatctcgcgcagagcatctacaacgcatccagcaagggtccgcagggcatcggtgcgctgtcggtgcagggttacctcagtgacccggacatccaggacctgttgctgtccaagctgcggctggctgatctggatgtctccacgctggacaacgccatgggcgtgatccgggtgaccaacggcgccacctggcgcacgtccgcgacgacgggtgcggatttcatgctggtcgacaatggcaccatcgcgctggaaggcggtgccctgcgcgcatcggaagtgcgcgtgctcggcgcaggcatgctggtcggccatggcgacgtggcgggtactgcgatggaccgcgctgcattgctggacggcaccggcccgtcgtaccgcgaagacggtttcaaccgcctgcgcgtgttcggcacgctgatgccgcgcggtggcgacctggtcacccatggctacgtcaacatcatgccgggcggcaaggtgctgttcgacgttacagagaatggcggcaccgctgcaggccgcctgcgcgtgggtaccttcttcgatgacgagcagaccgagggggcactggtgatctccaagggggccttcctcgaactgaacgtggcgcagggctactacggccaggatttccgtcgtgatctggttaagggcccgatctaccagggtggcttcgaagaggccgtgcgcctgggtgacaccggctacagtgccagcatcagcggtgatgtgttccgtccccgccacaattcgctgttgagcttcaacgtgaagcagacggccgatggcctgtggctgaccgccaaccccggctttgaccagctgggcctgttcgccaacggtacgtccggcgacggcctgggccgtgcgctggcgacggcctccgatcgccaggacaaggggctgagatcgctgctgggcgcactgcagttcgccgaccgcgatgtgatcgcacaacaggccggtgccctgcgcggtgatgcgcacgccagcctgcgcctggcagacaccgcactggtgggcagcatcggcaacgtcgtgcagcagcaccagtcggccatgcgcagcggcggcgatgccgatggcctggcctcgcaggtggcgcagtcggtctcctcccagccgggcatgcgccatggcagcctgttcaaccagctggcgatgcacttggtcgaaccggcgccgggcagcgttgcgggtagcggtgacgccggacgcagccatggcatctgggcacgtggtttcgccagccatggccgcatcgatgccggcggcggcgtggccggcctgagccacaacatcggcggcgtcgtggtcggtgccgacacccgcgtggccgatgaccgcgtgaccctgggcgtcagcgtggccgcggcggacatgtcgaccaaggccagcgatggctcaggtttcaccggtgatgtgcgcgcgctggacgtgggcggttacctcgatgcgacgtacgcgcgcggctatctgtcggcggccgtgcgctacaccgatctgcggcatgacacccgtcgcagcatcggcggtatcgatggcctgcagcagcccctgcgcgcgaagtacagcaacgatgcgatctccgcacgtgttgaacatgcgttctcgttcaccaacggcaagggcctggtgatccagccgttgctgccggtggtggactacgcgcgcacgtcggccacccgcttcaacgaagggcagggcgccggtgcgctggttggccgcagtggcagcctggagagcatccgcgtgggtgcgggcctgcagctgttcaagaccttcgaaggcaacaacggtgagcgcatcaccccgcgcgcccgggtggtctggcagaaggagctgggcgattcgcaggcccgctacagcaccggcttcgccgcagctccggatctgatgttcggcgccagcagccaggcggtgggcgagcaggtgctggcctggaacctgggtgtgaccagccgtgccagcgagcggctgtcgatcatggccgattacgtgggcgagcgccgcgacgggcagatccagaacggcgtgatgctgggcctgggctacaggttctaa

SEQ ID NO: 37 - DNA, 2874 bp, unknown
  environmental sample
atgaagcattcgaagttgagcctggccctggccgggctgatgggcgtcaccgccatggcggcggttgatgacgtcatggcaatgaattatcacgtgcgggacgatcgcgtcttcctcagcggcggcgtcaccgtcgccgacgtggtggcgctgcccgcactgctggccaaggcgcaggctgaaggccgtccgatccgcgaagtcgtgctgcgcacatccaatggcggcgcgctgatcgccggcgagtggctgcaggccgtgatccgcacccaggggctggacaccatcgtgtccggccactgcatctcgtcctgctcgatcatgcagtccggtggcgtcaaccgttacctcggcggcgatctgccgctggtcgattcggtgcagatccatgccgccagcagcggcggcaggatcacctacgcgccatcgccgcgcatgacccagatctacaccggcaattacggtggcggcatggatgcgggcctgctgcacaaggccatgtatgaggtggtgcagcccaatggcctgctggtattccgcgacccggcgcgcaccacgggtacgtcggtcaccttcgacccggatggcagcggcagcaagctggagacgttcccgggccaggacatccgcggcaacaacatcatcaacacggcaggctatcgcgatccgggcgacaccctccgtgtcaccagcaacgtcagcggcgacatcaacccgggctacctgcgcaccgcgcgccagctgcaggccttcgtcgacgacgatttcgcgcgctggaacaccgactgggccagcacctacatcaactacgcggtgagcctgtacaacgtctccacgcgggggccgaacggcatcggcacgccgtcgctgcaacagatgctcgccgatcccgacctccaggatgagctgcgcggccagttgcggctggccgatctggatgcgtccaccctggcaagttcggcgggcgtgatccgtgtcagcaacggcgccacctggcgcaccgccgaaaccaccggcgccgatttcatgctggtcgacaacggcaccatcgcgctggagggcggcgcgctgcgtacccccgagctgcgggtgatgccgggcagcgtggtggttggccatggcgacatcgcatcggtcggcaccgacagcgatgcgttgctggatggcaccggcccgtcctaccgcgaagacggcttcaaccgcctgcgtgtgttcggcacgctgatgccgcgtggcggtgatctggtgacccacggctacgtcaacatcatgcccggcgggcaggtgctgttcgacgttaccgaaacgggtggtaccggcagtggccgcctgcgcgtcggcagcttctacgatggcggctccgaggagggcgcgctggtgatcgcgcagggcgcacacctggcgttgaacgtcgcccagggcttctatgccggcacctaccgtcgcgacctggtggaaggaccgatctaccaggggggcttccaggatgccgtgcgactgggcgacaccggctacagcgccagcatcgctgccggtgaagtgttccgcccgcgccacaattcgctgctcagcttcaacgtcaaccagaccgccgacggcctgtggctgaccgccaatccaggcttcgaccagctgggcctgttcaccaacggcacctccggcgacggcctggggcgcgcgctggccgctgcatcggaccgccaggacagcggcctgaagtcgctgctgggtgcgctgcagttcgctgaccgtgatgtgatcgcacagcaggccggcgccctgcgcggtgacgcgcacgccagcctgcgactggccgacaatgcactgatcggcagcatcggcaacgtcgtgcagcagcaccaggcagcgatgcgcagtggtggtgatgcagacgggttggcttcgcaggctgcgcagtcggtctcgtcgcagccgggcatgcgccacggcagcctgttcaaccagttggccatgcatctggtcgagccggccggcgagggtgctggcgacagccgcacggcgagtggcagccgtggcctgtgggcgcgcggtttcgccagccatggccgcatcgatgccgacggcggcgtggccggcctgagccacaatgtcggcggcatcctgatcggtgccgatacccgcgtcgccgatgaccgcgtgaccctcggcgtgagcgtggccgcggccgacatgtcgaccaaggccagcgatggctccggcttcagcggtgacgtgcgcgcgctggacgtggggggctatctggacgcgacctattcgcggggctacctgtcggcagccgtgcgctacaccgacctgcggcatgacacccgccgcagtgtcggcggcattgatgggctgcagcagcctctgcgcgcgaagtacagcaacgatgccatctcggcacgggtggagcatgcgttctccttcaccactggaaagggtctggtgatccagccgctgttgccggtggtggactacgcacggacctcggccacccgtttcaatgaagggcagggcgccggtgcgctggtgggccgcagcggcagcctggagagcgttcgtgtgggtgccggcctgcagctgttcaagaccttcgaaggcaacaacggcgagcgcatcaccccgcgcgcgcgcgtggtctggcagaaggaactgggtgacacccaggcccgctacagcaccggcttcgccgcagctccggacctgctgttcggtgccagcagccaggccgtgggcgagcaggtgctggcctggaacctgggcgtgaccagccgtgccagcgaacgcctgtcgatcatggccgactacgtgggcgagcgccgcgatggccagatccacaacggcgtgatgctgggcctgggctaccggttctaa

SEQ ID NO: 38 - DNA, 2052 bp, Streptomyces Sp.
atgactcgtacccggctgaccgcgctggccgcgacggccaccctcgccgccaccggcggcctgatcaccgcctccccggcctccgcggccgtcacctgcacctctcctgtctggaaggcgcagtacttcggcaactccaccttcagcggcacgccgaagctgaccgcctgcgactccgccatcagtgagaactacggatacggcgacccgaccggcgtcacgctgcccaaggacaacttctccgtccgctggtccctcacccgggacttcggctccggcggccccttccggctctccgccgccacgcaggacggcatgcgcgtctacgtcgacggcgtgcggaagatcgacctgtggaagaacgtctccaccaccgcccgcaagaccgtcgacctgaccgtcccggccggcaagcacacgctgcgcgtggactacgtcgcctggaccggcaccgccaacgccgcgttcacgtacgccccgcgcaccgaggccgccgtcgacacggtcaagccgctcgccccgaccggcctcaccgccgcgtacaaccgggacaccacgaagaccaccttgcgctgggccgcgaacaaggagatggacctggccggctaccgcgtgtaccgccggctgagcaccacccagtgggcgagggccggcggcccgtcgctgctcacctccccgtcgttcgtggacacgacgcccgccacgggccagaccttcctgtacgaggtccgcgccgtcgacaaggcgggccgcgagtccgccggcagccccgacgccaccgttgcgaccgtggaccgcacgggcccggcggcgccgaccggtctcagggtcaccagcgacgcgtggtgggccaccctgtcctggcaggcgggcgccgacgccgcgaagtacgaggtgtacgccgcctccgcggccaccggcccgttcgagctgctgggcacgacgaccacgacgtcgtaccgcaccgacgcacccatgaacaccgcccgctactaccgggtccgcgccctcgacgcgctcggcaacccgtcggcgtacgccaccgtcaccggcgacggcgtcgaccggacgccgccgaagtccccgacctccctgggctccgtggtcggcttcggctacaccgacgtgtactggaatcagcccgacggcttctacgaggacttcgacaacggcgggacctaccacgtctaccgctcgaccggcaagaccctcgacccggccgcgctcacccgcgtgacctgcgccgaggagagcgacgagaccagcaccggcgggaagtgccacgacctgggcatgcccgcgggcacgtacgtgacgtacgcggtcgcggcggtggacccggccggcaacgagtcggcgctgtccgccccgctcgtcgtccgcaccggcgaccgcgtcgcgcccggcccggtcaccggtgtgaaggccaccccgcgtaccgacggtgtgctgctgagctgggcggcctcgaccgacgacgacgtcgagagctacgtggtccggaacggcacccggcaggcggacggcacgatcagatggctcggcaccagctcctgctgggagggcacgagcgacccgctcgcggtgctgtgcggcgacgtgccggacggcgagacgtacgtgtactcggtcgtcgccagggaccgctggggcaatgcgctgctcccgagcgacccgaaggtcacggtcgtcgaggccaccgagctggacgtccgcccgtccgtgacggtcacccgggactgggacctcggcagcatgggctacgacagcctgatcggcggacccggcgtgaaggggccgtccatcaactggaggtgcgacaagacggccgagtgcgacaccgtcgcgggctaccgggtcagccggtggaacgcggccacgaaggcgtacgagccgctgcacgccggactgctgccggcggagacccgtgcctacacggacaccacggccgtgcgggggaccacgtacttctacacgctggaggcggtgcgcgccgacggcagcgtcgcgggcacgcacgtgtggagctgcgtccttcaggaccgcgtctag

SEQ ID NO: 39 - DNA, 2052 bp, Actinobacteria Sp.
atgactcgtacccggctgaccgcgctcgccgcgaccaccgccctcgccgccaccggcgatctgatgatcgccgccccggcctccgcggccgtcagctgcgcctctcccgtctggaaggcgcagtacttcggcaactccaccttcagcggcacgccgaagctgaccgcctgcgactccgccgtcaacgagaactacgggtacggcgacccgaccggcgtcacgctgcccaaggacaacttctccgtccgctggtccctcacccgggacttcggctccggcggccccttccggctctccgccgccacgcaggacggcatgcgtgtctacgtcgacggcgtgcagaagatcaacctgtggaagaacgtctccaccaccgcccgcaggaccgtcgacctgaccgtcccggccggcaagcacacgctgcgcgtggactacgtcgcctggaccggcctcgcccacgccacgttcacgtacgccccgcgcgcggaggccgccgtcgacacggtcaagccgctcgccccgaccggtctgaccgccgcgtacaaccgggacaccgcgaagaccaccctgcgctgggctgcgaacaaggagatggacctcgccggttaccgcgtctaccgccgactgggcaccacccagtgggtgagggccggcggctcgtcgccgctcgcctccccgtccttcgtggacgcgacgcccgccacgggccagaccttcctgtacgaggtccgcgccgtcgacaaggcgggccgcgagtccgtcggcagtctcgacgccaccgcggtgaccgtggaccgcacgggcccggcggcaccgaccgctctcacggtcaccggtgacgcgtggtgggccaccctggcctggcagggggccgccgacgccgcgacgtacgaggtgtacgccgcctccgcggccaccggcccgttcgagctgctgggtacgacgaccaccacgtcgtaccgcaccgacgctcccgtgaacaccgcccgcttctaccgggtccgcgctctcgacgcgctcggcaacccgtcgccatacgcctccgtcaccggcgacggcgtcgaccgtacgccgccgaagtccccgacctccctcggctccgtcgtccgcgtcggctacaccgacgtgtactggaagcagcccgacggcttctacgaggacttcgacaacggcgggacctaccgcgtctaccgctcgcccggcaagaccctcgacccggccgcgctcacccgcgtgacctgcgcggaggagagcgacgagaccagcaccggcggcctctgccacgacctggacatgcccgcgggcacgtacgtgacgtacgcggtggcggcggtggacccggccggcaacgagtcggcgctgtccgccccgctcgtcgtccgcaccggcgaccgcgtcgcacccgggccggtcaccggcgtgacggccaccccgcgcgccgacggcatcctcatgagctgggcggcctcgaccgaggacgacgtcgagcgctacacggtctggaccggcgcacgacaggccgacggcacggtcaagtggctcaccaccgcctcctgccgggagggcacgagcgacccgctcgcggtcctctgcggcgacctgccggacggcgagacgtacgtgtacgcggtcgtcgccagggacctctggggcaacgcgctgcccccgagcgacccgaaggtcacggtcgtcgaggccaccgagctggatgtccggccgtccgtgacggtcacccgggactgggacctcggcagcctgggccacggcaccgtgatcggcggtcccgacgaggacgggccgtccatcagctggcggtgcgacaagacggccgagtgcgacaccgtcgcgggctaccgggtcagcaggtggaacgctgccacgcaggcgtacgagccgctgcacgccgggctcctgccggcccagacccgcgcctacacggacaccgcggccgcccgggggaccacgcacttctacacgctggaagcggtacgcgccgacggcggtgtcgcgggcacgtacgtgtggaactgcgtcttccaggaccgcgtctag

SEQ ID NO: 40 - DNA, 2052 bp, Streptomyces Sp.
atgactcgtacccggctgaccgcgctcgccgcgacggccgccctcgccgccaccggcgatctgatgatcgccgccccggcctccgcggccgtcacctgcgcctctcccgtctggagagcgcagtacttcggcaacaccaccttcagcggcacgccgaaactgaccgcctgcgacgccgccgtcaacgagaactacgggtacggcgacccgacgggcgtcacgctgcccaaggacaacttctccgtccgctggtccctcacccgggacttcggctccggcggccccttccggctctccgccgccacacaggacggcatgcgcgtctacgtcgacggcgtgcggaagatcagcctgtggcagaacgtctccaccaccgcccgcaagaccgtcgacctgaccatcccggccggaaagcacacgatccgcgtggactacgtcgcctggacggggctcgcccacgccgcgttcacgtacgccccgcgcacggaggcggccgtcgacacggtcaagccgctcgccccgacgggtctcaccgccgcgtacaaccgggacaccgcgaagaccaccctgcgctgggccgcgaacaaggagatggacctcgccggttaccgcgtctaccgcaggctgggcaccacccagtgggcgagagccggcggctcgtcgctgctcacctccccgtccttcgtggacgcgacgcccgccacgggccagaccttcctgtacgaggtccgcgccgtcgacaaggcgggccgcgagtccgtcggcagcctcgacgccaccgcggtgaccgtggaccgcacgggcccggcggcgccgaccggtctcacggtcacgggcgacgcctggtgggccaccctggcctggcagggggccgccgacgccgcgacgtacgaggtgtacgccgcctccgcggccggcggcccgttcgagctgctgggcacgacggccacgacgtcgtaccgcaccgacgctcccgtgaacaccgcccggttctaccgggtccgggctctcgacgcgctcggcaacccgtcgccatacgccgccgtcaccggcgacggcgtcgaccgtacgccgccgaagtccccgacctccctcggctccgtcgtccgcgtcggctacaccgatgtgtactggaagcagcccgacggcttctacgaggacttcgacaacggcgggacgtaccgcgtctaccgctcgcccggcaagaccctcgacccggccgcgctcaccccggtgacctgcgccgaggggagcgacgagaccagcaccggcggcctctgccacgacctggacatgccggcgggcacgtacgtgacgtacgcggtcgcggcggtggacccggcaggcaacgagtcggcgctgtccgccccgctcgtcgtccgcaccggcgaccgcgtcgcacccggtccggtcaccggcgtgacggccaccccgcgcgccgacggcatcctcatgcgctggtcggcctcgaccgaggacgacgtcgagcgctacgcggtctggaccggcgtccgacaggccgacggcacggtcaagtggctcaccaccgcctcctgccgggagggcacgagcgacccgctggcggtcctctgcggcgatctgccggacggcgagacgtatgtgtacgcggtcgtcgccagggacctctggggcaacgcgctgcccccgagcgacccgaaggtcacggtcgtcgaggccaccgagctggatgtccggccgtccgtcacggtcgcccgggactgggacctcggcagcctgggccacggcaccgtgatcggcgggcccgacgaggacgggccgtcgatcagctggcggtgcgacaggacggccgagtgcgacacggtcgcgggctaccgggtcagcaggtggaacgcggccacgcaggcgtacgagccgctgcacgtcgggctcctgccggcacagacccgcgactacacggacacgacggccgcgcggggggccgcgcacttctacacgctgcaggcggtgcgcgccgacggcagtgtcgcgggcacctacgtgtggagctgcgtcttccaggaccgcgtctag

SEQ ID NO: 41 - DNA, 2052 bp, Streptomyces Sp.
atgactcgtacccggctgaccgcgctggccgcgacggccgccgtcgccgccgtcggcggcctgatcaccgccgctcctgcctccgcggccgtcagctgcacctctcccgtctggaaggctcagtacttcggcaattccaccttcagcggcacgccgaagctgaccgcctgcgactccgccatcgccgagaactacggctacggcgacccgcccggcgtcacgctccccaaagacaacttctccgtccgctggtccctcacccgggacttcggctccggcgggcccttccggctctccgcagccacacaggacggcatgcgcgtctacgtcgacggcgtgcggaagatcgacctgtggaagaacgtctccaccaccgcccgcaagaccgtcgacctgaccgtcccgtccggcaagcacacgctgcgcgtcgactacgtcgcctggaccggcaccgccaacgccggtttcacgtacgccccgcgcaccgaggccggagtcgacagggtcaaaccgcttgccccgaccggcttcaccgccgcgtacaaccgggacacgaggaagaccaccctgcgctgggccgcgaacaaggagatggacctcgccggttaccgcgtgtaccgccggctgagcgccacccagtgggcgaaggtcagcggttcgtcgccgctcacctcgccctccttcgtggacgcgacgcccgccacgggccagaccttcctctacgaggtccgcgccgtcgacaaggcgggccgcgagtccgccggcagtctcgacgccaccaccgtgagcgtggaccgcacggggccggcgacgcccaccggtctcacggtcgccggcgacaactggtgggccaccctggcctggcaggggcccgccgacgccgcgaagtacgaggtgtacgccgcgtccgcggccaccggcccgttcacactgctgggtacgacgaccacgacgtcgtaccgcaccgaagcgcccgtgaacaccctccggtactaccgggtccgcgccctcgacgtgtccggcaacccgtcggcgtacgccgccgtcaccggcgacggagtcgaccggacaccgccggcgaagtccccgacctctctcggctccgtcgtcaacgtcggcgacaccgaggtgtactgggaccagcccgacggcttctatgaggacttcgacaacggcgggtcctaccgcgtctaccgctcgccgggcaagaccctggacccggccgcgctcaccggcgtgacctgcgcggagtggagcgacgagaccagcaccggcggcaaatgccacgaccgggacatgcccgcgggcacatatgtgacgtacgcggtcgcggcggtggacccggccggcaacgagtcggcgctgtccgccccgctcgtcgtccgcaccggcgaccgcgtcgcgcccggtccggtggggggcgtgaaggccaccccacgtgccgacggcgtgctggtgagctgggcggcctcgaccgaggacgacgtcgagcgctatgtggtccggaacggcacccggcaggcggacggcacggtcaagtggctcggcaccgcctcctgctgggagggtacgagcgacccgcttgccgtcctctgcggcgacctgccggacggcgagacgtacgtgtacgcggtcgtcgccagggaccgctggggcaatgcgctgtccccgagcgacccgaaggtcacggtcgtcgaggccaccgagctggacgtccggccgtccgtgacggtcgtccgggactgggacctcggcagcctgggccacggcagtttgatcggccccgagcaggacgggccgtccatcggctggcggtgcgagaagacggctgtgtgcgacaccgtcgcgggctaccgggtcggacggtggaacgcggtcacgaaggcgtacgagccgctgcacgccggactgctgcccgcggaaacccgtgcctacacggacaccacggccgcgcggggggccacgcacttctacacgctggaggcggtgcgcgccgacggcagcgtcgcggccacgtacgtgtggaactgcgtcttccaggaccgcgtctag

SEQ ID NO: 42 - DNA, 2049 bp, Streptomyces Sp.
atgactcgtcatcggctgaccgcactcgccgcgacggccgccctcgccgccaccggcggcctgctcaccgccaccccggccgccgccgtcacctgcgcctcgcccctctggaaggcgcagtacttcggcaactccaccttcagcggcaccccgaagctgaccgcgtgcgactccgccatcgccgaggactacgggtacggcgacccggccggcgtcaccctgcccaaggacaacttctccgtgcgctggtccctcacgcgggacttcggctccggcggtcccttccggctctcggccgccacgcaggacggcatgcgtgtgtacctcgacggggtgcggaagatcgacctgtggaagaacgtctccacgaccgcccgcaagaccgtcgacctgaccgtcccggccggccggcacacgctccgcgtggactacgtcgcctggaccggcgccgcgcgggccgccttcacgtacgccccgcgcaccgaggccgccgtcgacacggtcaagccgctggccccgaccggggtgaccgccacgtacgacccgggcaccacgaagaccaccgtgcgctggaccgcgaaccaggagatggacctcgccggttaccgcgtgtaccggcggctgggcagcacctcgtgggcgagggtcggcggcgcgtcgccgctcacgtcccgctcgttcgtggacgcgacaccggccacgggccagaccttcctgtacgaggtccgtgccgtcgacaaggcgggccgcgagtccgccggcagcctcgacgccacggcggtgaccgtggaccgcacgggcccagcggcaccgacgggtctcacggtcgtcggcgacgcctggtgggccaccgtggcgtggcagcgggtcgccgacgccacgacgtacgaggtgtacgcctccgccgcgcccgccgggccgttcgcgctgctgggtacgacgagcacgacgtcgtaccgcaccgacgcccccgagaacaccacccgttactaccgggtccgcgccctcgacgcgctcggcaacccctcggcgtacgccaccgtcaccggcgacggcgtcgaccggacaccaccgaagtccccgacctcgctcggctccatcgccgacgtcggcgccacccgggtgtactggaagcagcccgacggcttctacgaggacttcgacaacggcgggacgtaccacgtctaccgctcgtccggcacggtcctcgatgcggccgcactcacccgcgtcagctgcgccgagcagagcgacgagaccagcacgggcggcatctgccacgacctggacatgcccgagggcgcgtacgtgacgtacgcggtcgcggcggtggacccggccggcaacgagtcggcgctgtccgccccgctcgtcgtccgcaccggtgaccgcgtcgcgcccggccccgtcaccggcgtgaaggccaccccgcgcgccgacggcgtgctggtgagctgggcggcctcgcccgaggacgacgtcgagcgctacacggcgtggaccggtgtccgccaggccgacggcacggtcaagtggctcggctccgccttctgccgcgagggcacgagcgatccgctcgccgtgctgtgcggcgacctgccggacggcgagacgtacgtgtacgcggtcgtcgccagggaccgctggggcaacgcgctgctccccggcgacccgaaggtcacgctcgtcgaggccaccgagctggacgtccggcccgaggtgacggtcacccgggactgggatctcggcggtacgggatacggcacggtgatcggcggccccgaagaggacgggccgtcgatcacctggcgatgtgacaaggccgccgtgtgcgagagtgtcgcgggctaccgggtcagccggtggaacgcggccacgaaggcgtacgagccgctgcactcggggcttttgccggccgcgacccgtacctacacggacaccaccgccgcgcggggggccacgtatttctacacgctccaggcggtgcgtgccgatggcggcgtcgcgggcacccacgcgtggagctgcgtcttccaggaccgcgtctag

SEQ ID NO: 43 - DNA, 2043 bp, Streptomyces Sp.
atgactcgtacccggctgtccgcgctggccgcgacggcggcgctcgccaccaccggcggcctgatcaccgccgcccccgcctccgcagcggtcacctgcacctctcccgtctggagggcgcagtacttcggcaactccaccttcagcggcacgccgaagctcaccgcctgcgacaccgccatcagcgagaactacgggtacggcgatccggccggcgtcacgctgcccaaggacaacttctccgtccgctggtccctcactcgggacttcggctccggcggccccttccggctctccgccgccacgcaggacggcatgcgcgtctacgtcgacggtgtgcggaagatcgacctgtggaagaacgtctccacaaccgcccgcaagaccgtcgacctgaccatcccggccggcaagcacacgctccgcgtggactacgtcgcatggaccggcgccgccaacgccgccttcacgtacacccctcgcaccgaggccgccgtcgacacggtcaagccgctcgccccgaccggcctcaccgccgcgtacgacaggacgaccgccaagaccaccctgcgctggaccgccaacaaggagatggacctcgccgggtaccgcgtgtaccgccgactgagcgccaccagctgggccaaggtcagcgggacgtccctgctgaccacccggtccttcgtcgacgcccctcccgccaccggccagaccttcctgtacgaggtccgcgccgtcgacaaggccggccgcgagtccaccggcagcccggacgtgacggcgacgaccgtcgaccgcaccgggccggcagcccccaccggactcacggtcgccaccggcgacgggtggtgggacaccctgaactggcagggagtcgccgacacggcgaagtacgaggtgtacgcctcgtccgcggctgccggaccgttcgagctgcgcggtacgacgaccacgacgtcgtaccggaccagcggcgccgtgaacacgaacacgtactaccgggtccgggccctggacgcagccggcaacccgggggcgtacgcgacggtcaccagcgacggcgtcgaccggatgccaccgaagtccccgaccggcgtcaccgccggcgcccgtcccggctacaccaatgtgcactggagccagcccgacggtttctacgaggactgggacaacggcgggcactaccgcgtgtaccgctcgcccggcaagacgttcgacccgaccgcgcgcacccaggtgacctgcgtcgcggaggagagccacgaggcgagcaacggcggcaactgctacgacgtggacatgcccgcgaacacgtacgtgacgtacgccgtcacggcggtggacccgtacggcaacgagtcggcgtactccgcgccggtcgtcgtccgcaccggcgacaccgtggcgcccggcccggtcaccggcgtgaaggtcaccccgcgcaacgacggcatgctggtgagctgggccgcttcgcccgaggacgacatcgacgagtacgtggtctggacgggcgtccggcaggccgacggcacggtcaagtggctcggccccgccacctgcgcggagggcacgagcaactggctcgcgatcctctgcggcaacctgccggacggcgaggcgcacgtgtacgcggtgacggccaaggaccactggggcaacacgctgcacccgagcgacccgaaggtcaccgtggtcgaggccaccgagctcgacgtccggccgtccgtgaccgtcacccgggactggagcctcggcagcctgggccacaaccggacgaccactcgtccgtccgtcgactggcagtgcaccgacacgacccgctgcgccacggtcaccggctaccgcgtgagccgatggaacccggcgaccaaggcgtacgagccccagcacgacggactgctcccggcggacgcccggacctgggaggacgccacggcgacgaaggggaacacatacttctacacgctggaggccgtgacggccgacggcgccgtggtggggacgtacccctggtacaccgtcttccaggaccgcgtctag

SEQ ID NO: 44 - DNA, 2010 bp, Streptomyces Sp.
atgactcgtacccggctgagtacgctggccgcgacggccgttctcgccgccgtcggcggcttgatcaccgccgtcccggcctccgcggccgttacctgcacctctccggtgtggacggcgcagtacttcgccaacacctcgttcagcggcaccccgaagctgaccgcctgtgactcggccatcgccgagaacatgggctctggagacccggccggtgtcacgctgccgaacgacaacttctcaatccgctggtccctcacccgggacttcggctccggcggtcccttccggcttgccgcggccacccaggacggcatgcgcgtctacgtcgacggcgtgcgcaagatcaacctgtggaccaacgtctccaccaccgcgcgcaagaccgtggacctgaacatcccggccggccgccacacgatccgtgtggactacgtcgcctggactggctccgcctacgccgggttcacctacaccccgcgcaccgaggcgagcgtcgacacggtcaagccgctggccccgaccggtctgaccgccgcgtacagccgggacaccgccaagaccacgctgcgctggacggccaacaaggagatggacctcgccgggtaccgcgtctaccgccggctgagcaccaccccgtgggcgaaggtcagcggcagctctctgctcaccaccccctccttcgtcgacacgccgcccgcgaccggccagaccttcctgtacgaggtccgcgccgtggacaaggccggccgcgaatccaccggcagcgtcgacgtcaccgccgcgacggtggaccgcacgggcccggcggccccgaccggtctcacggtcgtcagcgacgcgtggatggccaccctgagctggcaggccgtctccgacgcggcgacgtacgaggtgtacgcctcgtccgcggctaccggcccgttcgagctgctcatcacggcgactacgacgtcgtaccgcaccagcgcgcccacgaacgcgaaccagtactaccgcgtctacgccacggtcgccggcgacggcgtcgaccgcacgccgccggggtccccgagcggcctgaactccgtcgcccgtcccggctccaccgcggtgtactggacggcgcccggcggccgctgggtcgaggactgggacaacggcgggcactaccgcgtgtaccgctcgcccggcaagaccttcgacccggccgcgcgcaccgaggtggcctgcgccgaagaggggagcaacgaggcgggcaacgggggtgcgtgcgtcgacctgggcatgcccgtgaacacgtacgtgacgtacgccgtcacggcggtggacccggacggcaacgagtcggcgtactccgccccgctcgtcgtgcgcaccggcgacacagtggcgccgggcccggtcaccggcgtgaaggtcatcccgcgcagcgacgggatgctggtgagctgggccgcctcgcccgaggacgacatcgacgagtacgtggtgtgggccggcgcccggcaggccgacggcacggtcaagtggctcggccccgaccgctgctgggagggcgtgagcaacccgctcgcgatcctctgcggcaacctcccggacggggagactcgcgtgtacgcggttatcgcgaaggaccactggggcaacgggctgcacccgagcgacccgaaggtcatcgccgtcgaggccaccgagctcaacgtccggccctccgtgaccgtcacccgggactggaacctcggcagcctgagccacaacccgacggccgcccgcccgtccgtcgactggcagtgcaccgacacgacccggtgcggcaccgtcaccggctaccgcgtgagccggtggaacccggcgaccaagacgtacgagtcccagcacgacggactgctcccggccgacgcccgaacgtggacggacctcacggcaacgaaggggaacacgtacttctacacgctggaagccgtgacggccgacggcgccgtggtggggacgtacccctggtacacgatcttccatgaccgtgtctga

SEQ ID NO: 45 - DNA, 2268 bp, Streptomyces Sp.
atgcgaatatctctcggcacgacgcgccgtacaggtggtgcggccgtgctctccttggcaacagccctggccgggctcgccttccccacgaccgcgcatgcggccgtgacctgctcggccggcgtgtggaaggcccagtactacgccaacaccaccctctccggcactccgaaggccaccgtctgcgacagcgccgtcgccgagaactacggctccggcgacccgtccggcgtgaccctgccgaacgacaacttcggcgtccgctggaccaccacccgcaacttcggctccggaggccccttcgacctgagcctcgccgtccaggacggtgcccgcgtctacctcgacggctcccgcaagatcgacctgtggcgaaacgtcacttcgacccagcggaagaccgtacgcctcaccatcccgcgtgggtcccacaccctgcgcgtggacttcgccgccttcaccggcaccgccaacatctccttctcctacgcgccggtcatcggcgccacgtacgacaagaccgtccccctatccccggtcggcgtgaagtccagtttctcggcgtccacactgaagacgaccctgacctggtcccgcaactacgagatggacatggccggttaccgcgtctaccgccgcgtcgccggcaccagcagctggagcctgcgcaactccactctgatcacgggcaccaccttcaacgaagcgcccccggcgaccggcgccgcctacgagtacgccctccgcgccgtcgaccgctccggcaacgtctccccgctgtccgcggtgacgagcgtcgtcagcgccgacaggacggcccccgccgtgcctaccgggctcacggccacgtacgacccgtccgccggcgcccggctcgcctggtccccggcgagcggggcgagctcctacgaggtgcagcgggccgtcgcgcccgaggggccgttcgccccggtcggcgcgccccttcagggcgcagccctgaccgacccggccgccgccgtcggcacgacctactactaccgcgtgcgggccaaggacggtgccggcaacgcctccgcgtactccgcgcccgtccggctcgacgccgccgaggccaagccgctgccgccgacggccgtctccgccaccggccggctcgaccgcaacaccgtcggctggcagtacgacggtgacgcgtcccaccaattccacgtctacggcgccgactcggccgccggcccgtggacccggttgaccgacacgccggtcgccggcaccagctacgacgaccacgcggcgcccgtcggcgaggcgcgctactaccaggtcaggacggtcacgacactcggcacggagtcggacccgtccacgactgcctcggccacccgaatccgcgacgtcaccccgccgcacatgccgtacggcctggacgcctgggacgccacggacggtgtgcacctcgtctggacgcccaacaccgacgacacggaccactatctggtcatgcgcaagacgatgttcggcgcgtgggagcagatcgccgtggtgcgggacggcacgtacctggacaccagcaccgcgcccgacgtccagttcggttacaccgtccgcgccgtcgacggcgccggcaacgtctcccccctgcccgagcccggctacggcaccgtctacggcaagcgcctgccggtctacgagaagccggccgcgcccgcctcggtgaccgcgacggccgacaacggcaacgtcaaggtggagtggaccccgagcacgtcgaccgacgtggccggctactacgtctaccgcacgaccgtcacggacccgacgacggcctactcggtctccccgctcatcaccgggacgacgttcacgaacgtggacgtgcccgccggcaattcctggtactacgtggtgcgcgtcgtcagtacccacagccagtggtccgactactcgccgatggccgcggtcaccgtgccctgcccggtcctgaccggaccgcccaccccccggatcaccggaggcggcaggggcgcggactacgcccagctcaactggcaggtcggaacgtgcgaccagggtgcgaccgtctcgtacaacgtctaccggtccacgtccagcgcggacgtcttcacccctgagcgccgcatcgccacgggcgtgacggcactgacgtacaaggatcccggtctggcacgggcgtactactactacgtcgtcaccgccgtggccgccgacggcaccgaatcggccccgcaggcaacgccgttcgggatatcgatgatggcaccctga

SEQ ID NO: 46 - DNA, 2007 bp, Streptomyces Sp.
atgcggagccgccgtggcacccgcagagcggtcggcactgccctcgtgggggccgtcgcgtgcctcgcgctacccgcctccggcgctcaggcggcaaccacctgcgccgccggagtgtggaaagcgtcgtactacgcgaacaccacgttcgccgggacgtcgaagctgaccgtgtgcgacacagcgatcagcgagagctacggcacccgagaccccgcaggcgtcacgctcccacgcgacaacttcggggtccgctggacgatgacgcgcaacttcggttccggcgggcccttcaccttcagcgtggccgtccaggacgccgtccgcgtctacctcgacggcacccgcaagatcaacctgtggtccaacgtctcgtcgacccgcagcaagacggtcaacgtcaccgtccccaagggcacgcacaccattcgcgtcgacttcgccgccttcaccggaagcgcgaacgtcaagttcggctacgcgcccaaaacctcggccaccgtcgacaagaccgccccgctcgccccgaccggcgcgagggtctcgtacgaccaggcctccagcaaggccacgttcacctggtccaagaacaaggagatggatctcgccgggtacaaggtgtacctgcgcagaccgggcaccagcaccctggtggtgcggacgaccgccacgtcctacacgacgacgctgcccgccacgggtgcggtctaccgattcggcgtcgacgccgtggacagggcggggaacacgtcgtcctccggcatcgatctgcccgtcacgaccgctgaccggacggctccgcaggcacccatcggactgacggcggctgacagccagtgggacgtcactctgagctggacggcgagcgaggcgggctccaccttcagggtgtaccgggctgactcgaccaccgggccgtactccctcgtcggtacgacgaagtcgacgtggctgaccctcaccgacgccccttacagcacgccccgccactacaaggtgactgccaccgacgtctcgggcaacacctcggcggcgtccgccgtgctgtcctacacccggcccacggccgtcccctggctctaccacgccgagaataacgaggcggacaccggtatccgtctgctctgggaagcgcgcctgaacgccggcacgacggggttccgcgtctaccgcgccgagcccggctcggccgacccctcctggcatgccgtcacgtgcgaggacttcgggcagggcggctcgaccccatacgtgcaggtccactactgcaccgaccggagcgcggtcgccaggaccgcgtaccagtacacggtgacgtccgtcgacgccaaggggcgggagtcggagcggtccgtcccgtattcgatcacgcgcgtggacaggacgcccccgcccgcggtcaccggggtgacggccaaggccacgccctacggtgtggtgctggactgggatcccagcacggcgcccgacatcgccaagttcatcattcgcagggagccggaagagaagcttccctgctggtgcaatctggccgaagtcgacgccgccaccacccacttcgtggacgcggagctgccggacggcgagaccctgacctactccgtggatgccgtggacacctcggggaactccctctacacgctgtacctgaacccggaagacgagggcatgacgttcgccgacgtgacggagctggatctgactccgtccgtcgacacgccggcgggcgcgccgctcgatctcacggccacggccgctgattcgggccacacggtggagctgcgctgggacgcgatcggggaagcgaccggttaccgcgtccaccgctggaaccccgacgccgcggcgtacgagccgctgacggcggagccggtcaccgatctctcctacacggacaccacagccgccacgggtaccacccacttctactgggtaaccgccgtgtacgccgacgggaccgagtcggccccgggggccgcctggacgatcctgcagcccgggagctga

SEQ ID NO: 47 - DNA, 2010 bp, Streptomyces Sp.
atgaccccagccagacgtacgacggccgtggccaccaccgccgtcgtcctcgccaccgcgggcaccctgctcaccaccgccccggccgcgaacgcggccgtcacctgtgcgtcacccgtcttcaaacggcagttctacgccaacaccggcttctccgggaccccgaagaagaccgactgcgactcggcgatcaacgagaactggggcgcgggggccccggcttccggactgccgtccaacaacttcggcgtccgctggaccgtcacccgcgacttcggctcgggcgggcccttcaccttcacggccgccgcccaggacggcatccgggtctacgtcgacggcaagcgcaagatcgacctctggaagaacgtctccagcacgcagacgaagacgctcaacctcaccatcccctccggcaagcacaccctccgcgtcgactacgtgaactggaccggctccgccaacgtcaagttcacctacgcgccccgcacctccgcaaccgtcgacaaggtcaagccccttgccccgaagggcatttcggtcgcgtacggcaaggccaccaacaaggcgcggctgacgtgggcgaagaacgccgagatggacctcgccgggtaccgcgtgtaccggcgcctgtcgaccgcctccacctggacgaaggtcgggacgaccacggccacctcgaccaccgcctacaccgacagtccgcccgccaccgggaagtcgtacgtctacgaggtgcgcgcctatgacaaggcgggcaacacctcgacgggatccgccgatctgtccgtcaccgccatcacactcgccacgcccaccgggctgaccgcgacgggcgcggacgccgggatcgccgtctcctggcagccggtcgcgggcgcggtgaagtaccggctggcgcacgacgacagcggggcgtacaccacggtcacgggcacgtcgtacaccgacagttcggtggcgcggtcggtgtaccgcagctacaaggtggcggcggtggacgcctccggccatgtctccgcgtacagcgcggtgacggcacaggtgcggcggccggtcgccgcgccgtacgggatggtcgcgtcggcggccagtggcaccggggtgtaccggctctacgtcaactggaccgtcaacacggccacgggcggcgcctacgacacgttccacgtgtaccgctcgacgagcctgccggtggacaccacggccgagccgttcgtgtgcgacgacctcagctacaacatcggggacgacgagcgcggctacagctgccgggacgagcaggtggcccccgccacgacctaccactacgtggtgaagggcgtcgacgacaccggcaccgagtcgcttccctcggccaccgtcagcgtcgccacgcccaccccggacaccaccgcgccggcgcccgtcaccggcctgaccgcgacgcccaccaagtacggcatcgagctggactgggcggacaacgccgagtcggacgtcgtgcggtacgtcgtctaccggggcgttccggcaggggacggcgacggacagagctgcggctcgctcgggcagatcggcaccgccttcaagtcgcagtacacccacctcaccctccccgacggcggccgtaactgctacctcgtggacgcggtggacgacgcgggcaactcggcctacacggcgaccggacaggccacgacggtccacgtgaccgaactcgacgtcaggccgtccgtcgcctcgccgaccgaaccgcccgtgaccgtgaacgggttctacgacacgtctttcggccgggtcgagctgtcgtggaacgtgcgctacccctacgacaccaacaagtactacgtgtaccgctggaacccggccacgcaggcctacgagaagctgaccaccacgccgctgaccaccaagcggtacttcgacaccaccgccgagcccggcacgacccacttctactgggtgacggtcgcctacaccaacggcgagtcggagcccggctccacgtatgtgatccggcagccctga

SEQ ID NO: 48 - DNA, 1137 bp, Bacillus Sp.
gtgttcatccttgccgcagcggtcttatgcttcttctatttccgcacagaagagcctgcggaggttgatagggaaatattaaatgcccctgattttctgaaaaataaagaagcgctgctgtatttctccactgcggctgaccaagacacgttcggcggcggaaaaagctatgccctcttcgccgataaaaaggggcggctctcttcttatcaaatgaaggggcttgagctcggatcggccaaagtgcatgacggcagcgtgctgctggaggacaaaaaaggaatctacaccgttcaaaatggtcttcacacatataaaagaacgtatcagcatacgggagacagcgcgggatatatcgaacggacgaaaggcttttacacgctgtacaattcgggctacgacaagagcggcggcagctaccgctcagagctgtaccgccagattgacggcaggtggaagcaaaacgtcatcccgcactatatccgcgcctcaggcttttttaaagatcatcttttcgcgctcacgccgacatatgacgaaaaaggctatcacatagaagacattcaggccgataaagaaaagctccatacaaaatcaattgcgacatggacgtataaagaaggcacgtcagtcgaatcccagctcgccgcggacgacggcgccgtctgctttgtcaccagaggggaaaaagcagaacacatctaccaaatggtgaaagttatgagaaagagcggtgcgatcaaaacatatgacatcgccacctatagaaatgacgaacagactatatatgactccatgccgttcagcttcaaaaaaagctttttcatggagcggcgcagcttctatttcgttgacggcttcggaaccgtctaccgcatcaaccctgagaccggaaaaagcaaaaaggccttcaccctccccgcatcacgaatgaaagccgacttcaaagacctgacgcatcaaaacggaaagctgtatctgttcacgtacagctacaaaaagcccgccaaaattgaatccttcgatctgaaaacgggcaaaaaactgaacgaccggaccattcccagcctgcaagacatcgtgtcaccgaaaagccatctcaagctgtatgatgtgcaggtgatggatgggttttga

SEQ ID NO: 49 - DNA, 1068 bp, Rhodococcus Sp.
ttgcgcaaaaaatcgttgggccttaagggtcgaatagcgctcgcgctgtcactgtcggtagcgggcgtggtcgcgacacaagcgccagccattgccgatacgtggagtaacgggcatatcgtgaaaggcgctatcgaggccgaatggctgaggcttggacccgacaatgtcggctgggcagtcactgacgaactcgatgcaaactaccttggcaagttccaggtgttcgaacggccggccccgcacatgggcaactcgatctactggcataacgacacgggagcgcatcaggttggcggattgattcgcgacaagtatcgcgaccttggctgggagagtggggatctgcacttcccgactaccagcgagacccagacgccgatcaagcccggcgcgttcaaccacttccagggtgggtcaatctactactcctcgtcgaccggcgcgtggccgacttggggagcaatccgcgacacctgggcgaatgctggctgggagaacagtggatacgggttccccaagtcgtatgagtacaactgcaacgacggaatcaacccgaacgacaagtcgtggaactacggagggaagggacaggactaccaaggcggccggatcttctggaactctgcgccgaacaacttcaacctcccgtacagctcggtgcacggatcgccccgcactctgaagtacagctctacaacgaaatacacttcggcacagagcaatgcgatcagccagtggaacgcactcggtcgagtgaacatcgaaccggcgaccgtcttgaacaacgaggtcctggtcgtccgcgacatcaaccgctcagactacacatgggcggggctctacacttaccgaggggccgacttctctaccttggagatgaatgacgccaaattcaccggcccatctgacagccggatcccacgcgtgatgacccatgagtggggccactccctcggcctcgcccacagttgcgtcggctccaacatggacgagctgatctacttcaataacaacccgaacctgtctgacctcgacaaatcatcgtacaacacgaaacatccataa

SEQ ID NO: 50 - DNA, 3687 bp, Streptomyces Sp.
gtgcacagaaaacgccccagagccagaaccctcctcgcactcctgacgggcgctctgctcgcaggatcgagcctcagcgccgtacccgccgccgcgcatccggacgagccggccgcggaggagagcttccagcaggtgaccctcgcgaagggcgccgacgcggtcggcgagcccatgtcgctcgccgtcctgcccgaccgccgggtgctgcacacctcgcgtgacggcacactgcgcatcaccgacgccggcggcgacaccaccgtctccggcacgctggatgtctacaaccacgacgaggagggcctccagggcgtcggggtcgaccccgacttcgcggagaaccgggccatttacctcttctacgcgcccaagctggacaccccggcgggcgacgcccccgagaacggcacggcggccgacttcgccccgttcgacgggtacaaccggctctcgcggttcacactcaacgaggacggcacgctcgacaaggcgagcgagaagaaggtcctcgacgtcaccacctcgcgcggcacctgctgccacgtgggcggcgacatcgccttcgacgcggacggcaacctgtatctgtcgaccggcgacgacaccaacccgttcgcctccgacggctacacgccgatcgacgagcgggccgaccgcaacccggcgttcgacgcccagcgttcctccggcaacaccaatgacctgcgcggcaaggtcctgcgcatcaaggtcgccgaggacggctcgtacaccatccccgagggcaacctcttcgccccgggcaccgagaagacccggcccgagatctacgccatggggttccgcaaccctttccgtatctccgtcgacaagaagacgggcatcgtctacgtcggtgactacggtcccgacgccggcgccgcgtccccgacccgcggtccggccggccaggtggagttcgcccgggtcaccgaggcgggcaacttcggatggccgtactgcacgggggacaacgacccgttcatcgactacgacttcgccaccaaggcgtccggcgcggccttcgactgcgcggcgcccaagaacacctcgccgcacaacacgggtctgacggacctcccgccggcccaggcggcctggatcccgtacgacggcggcagcctgcccgagttcggcagcggctccgagtccccgatgggcggaccggtctaccggtacgacgccgacctcgactccccggtcaagttccccgaggagtacgacggggacttcttcgccggtgagttcggccgccagtggatcaagcggatcgagcagggcgaggacggcaccgtcagcaagatcaacccgttcccgtggtccggcacccagcccatggacatggagttcggccccgacggcgcgctctacgtactcgactacggcctgtcctggttcggcggcgacgagcactccgcgctctaccgcatcgagaactccacgggcggcaagtcaccgatcgccgaggcgaccgcgaccaagacgtcgggcaagtccccgctgaaggtcaccttctcctctgcgggcaccgaggaccccgacggcgacgccctcacctacgcgtgggacttcggcgacggcggcacctcgaccgagaccagcccctcgtacacgtacaagaagaacggcacctacaccgcgcggctcaccgtcaccgacccgaccgagcgcaccgcgaccgcgtccgtacggatcgttgtcggcaacaccgcgcccaaggtgacactcgaactccccaacgacgggcacctcttcaacttcggggacaccgtccccttcaaggtgaaggtcaccgacccggaggacggggtgatcgactgctccaaggtcgtcgtccgctacatcctcggccacgacagccacggtcacccgatcacctcggccaacggctgtgagggcaccatcaccgcgcccgccgacaccgagcacgatcccaacgccaacatcttcggtgtgatcgacgccgagtacaccgacggcggaggcggcggccaggcggcgctcaccacgcacgaccagtcgcagctccagccgcgccaccggcaggccgagcacttcaacaactcctccggcatcaaggtctacgacaaggcaccggccaacggcggcaagaccgtcggcgacatcgacaacggcgactggatctccttctcgccgtacaacctgaccgggtccaagacgctcaccgcccggatctcctccggcggcgccggcggattcctggaggtacgcagcggctcggccaacggcaacctgctcggctccgcgccgatcccggtcaccggcggctgggagaccttccaggacatcgacgtaccgctccgtgccgtacccaagcagaccaccgagctgttcctggtcttcaagggcggtgccggcggcggcgcgctgtacgacctggacgacttccagctctccacggccgtgcccggcaagaccgagaagcgggtcctggtcttctccaagaccggcggcttccgccacgactcgatccccgcgggcatcgccgcgctcaaggagctcggcaagaccaccgggatcaccgtcgacgccaccgaggcggccggccagttcaccaccaacaacctggccaggtacgacgcggtggtcttcctctcgaccaccggtgacgtcctcaacgccgaccagcagaaggcgttcgagaactacgtcgccaccggcggcggctacctgggcgtccacgccgcggcggacaccgagtacgactggtccttctacggcggtctggtgggggcctacttcgactcccacccgcagatccagccggccaccgtacgcgtcgaggaccacgacaacccgtcgaccgcccacctgggcgacgagtggcagcgcaccgacgagtggtacaactaccgcaccaacccgcgggatcaggcccgcgtcctcgccaccctggacgagaccacctaccagggcggcaacatgaagggcgaccacccgatcgcctggtgccagacctacgagggcggccgtgccttctacaccggcggcggccacaccaaggagtcgtacgcggacgacgccttccgtcagcacctgctcggcggactgcggtacgcggccggccaggtgaaggcggactgcacgccgaagaccggctaccgggacctcttcaacggcaagacgctggagggctggaagcaggcgggaccgggcaagttcaacgtcgtggacggtgaactgcgctccgagggcggcatgggcctgctgtggtaccaggccaagcagctggagtcgtactccctgaagctcgactggaagatggacggggacgacaactccggtgtcttcgtgggcttcccggcctccgacgacccgtggtccgcggtcgacaaggggtatgagatacagatcgacgccaccgacgcggccgaccgcaccaccggctccgtctacggcttcaagtcggccaacatcaaggccagggaccaggttctgcggcccccgggccagtggaacaactacgagatcaaggtccagggtgagcgtctgcagatcttcctcaacggcgtgaagatcaacgacttcaccaacaaggaccccgagcgcagtctgaaggacggctacatcggcctccagaaccacggtgcggacgaccaggtgtccttccgtgacgtccagctcaaggaactgccctccgcctag

SEQ ID NO: 51 - DNA, 753 bp, Bacillus Sp.
atgatgtgtaaaaagctgttcaaagccgtcctcccgtttgccctgtcattcaccatggttctgtcattctccggtatgaatgtaaaagcgaaagaaacagaagcagcccgctacgcaaaagaaatcgcagaccttcagcagggcacgactcctcaagacgttctccaatccgccaaagagcttgccaaacagaagcacgtttcaacagaagcaattctcaagcagtttcatcaagaaatcacagcagacaaggtgcaaggaaatgtaatcgtttccaaagaagggctctctgcaatgggcggatcatcaggcacaaaaaaacttccgaaaagcacgaaaggcaatatttattacacgaactcatacacggcttattacaaccacgggcatgtcggcatgtattcatccgctgataaaattgttgaatccgtgccgggagacggcgtccgccagattgcttataacggcagggaagtcgaagacaattcaatcgtccagacggtgaaagtcactgatgcccaaaaacaagccgccgctgactgggccgtatcaagagtgggggatgaatactccttcaacttcgtcaataacagaaatacgggccatgaaggcgccaaaaactgctcaaaactgctgtggtcggcattccttttaaaagccgggattgatatcgactctaacggcggcttaggcgtatatccgcgcgacatcacaagctcgtcctacacaaccacgattctgaccattcactaa

SEQ ID NO: 52 - DNA, 753 bp, Paenibacillus Sp.
atgatgtgtaaaaagctgttcaaagccgtcctcccgtttgccctgtcattcaccatggttctgtcgttctccggtatgaatgtaaaagcgaaagaaacagaaacagcccgctacgcaaaagaaatcgcagagcttcagcagggcacgactccccaagacgttctccaatccgccaaagagcttgccaaacagaagcacgtttcaacagaagcaattctcaagcagtttcatcaagaaatcacggcagacaaggtgcaaggaaatgtaatcgcttccaaagaagggatctctgcgatgggcggatcgtcaggaaccaaaaaacttccgaaaagcacaaaaggcaatatttattacacgaactcatacacggcttattacaaccacgggcatgtcggcatgtattcatccgctgataaaattgtcgaatccgtgccgggagacggcgtccgccagattgcttataacggcagagaagtcgaagacaattcaatcgtccagaccgtaaaagtcaccgacgcccaaaaacaagccgccgctgactgggctgtatcaagagtcggtgatgagtactccttcaacttcgtcaataacagaaatacgggccatgaaggcgccaaaaactgctcaaaactgctgtggtcggcattcctcttaaaagccgggattgatatcgactctaacggcggcttaggcgtatacccgcgcgacattacaagttcgtcctacacggccacgattctgaccattcactaa

SEQ ID NO: 53 - DNA, 750 bp, Bacillus Sp.
atgtgtaaaaagctgttcaaagccgtcctcccgtttgccctgtcattcaccatggttctgtcgttctccggtttgaatgtaaaagcgaaagaaacagaaataccacgctacgcaaaagaaatcgcagaccttcagcagggcacgactcctcaagacgttctccaatccgccaaagagcttgccaaacagaagcatgtttcaacagaagcaattctcaagcagtttcatcaagaaatcacggcagacaaggtgcaaggaaatgtaatcgcttccaaagacggactctctgcgatgggcggatcgtcaggaaccaaaaaacttccgaaaagcacaaaaggcaatatttattacacgaactcatacacggcttattacaatcacgggcatgtcggcatgtattcatccgctgataaaattgtcgaatccgtgccgggagacggcgtccgtcagattgcatataacggcagagaagtcgaagacaattcaatcgtccagaccgtgaaagttaccgatgctcaaaaacaagccgccgctgactgggccgtatcaagagtgggtgatgagtactccttcaacttcgtcaataacagaaatacgggccatgaaggcgccaaaaactgctcaaaactgctgtggtcggcattccttttaaaagcggggattgatatcgactctaacggcggcttaggcgtatacccgcgcgacatcacaagctcgtcctacacaaccacgatcctgaccattcactaa

SEQ ID NO: 54 - DNA, 750 bp, Bacillus Sp.
atgtgtaaaaagctgttcaaagccgtcctcccgtttgccctgtcgttcaccatggttctgtcgttctccggtatgaatgtcaaagcgaaagaaacagaagcagcccgctacgcaaaagaaatcgcagagcttcagcagggcacaaccccgcaagacgttctccgatccgccaaagagcttgccgagcagaagcacgtttcaacagaagcgattctcaagcagtttcatcaagaaatcacagcagataaggtgcaaggaaatgtaatcgcttccaaagacagactctctgcaatgggcggatcatcaggcactaaaaaacttccgaaaagcacaaaaggcaatatttattacacgaactcatacacggctttttacaaccacgggcatgtcggcatgtattcatccgctgataaaattgtcgaatccgtgccgggagacggcgtccgccagattgcttataacggaagagaagtcgaagacaattcaatcgtccagaccgtgaaagtcactgatgcccaaaaacaagccgccgctgactgggctgtatcaagagtgggtgatgaatactccttcaacttcgttaataacagaaatacgggccatgaaggcgccaaaaactgctcaaaactgctgtggtcggcattccttttaaaagcggggattgatatcgactctaacggcggcttaggcgtatacccgcgcgacatcacaagctcgtcctacacaaccacgattctgaccattcactaa

SEQ ID NO: 55 - DNA, 750 bp, Bacillus Sp.
atgtgtaaaaagctgttcaaagctgtcctcccgtttgccctgtcgttcaccatggttctgtcgttctccggtacgaatgtcaaagcgaaagaaacagaagcagcccgctacgcaaaagaaatcgcagagcttcagcagggcacaaccccgcaagacgttatccgatccgccaaagagcttgccgagcagaagcacgtttcaacagaagcgattctcaagcagtttcatcaagaaatcacagcagataaggtgcaaggaaatgtaatcgcttccaaagacggactctctgcaatgggcggatcatcaggcacaaaaaaacttccgaaaagcacaaaaggcaatatttattacacgaactcatacacggctttttacaaccacgggcatgtcggcatgtattcatccgctgataaaattgtcgaatccgtgccgggggacggcgtccgccagatcgcttataatggaagagaagtcgaagacaattcaatcgtccagaccttgaaagtcactgatgcccaaaaacaagccgccgctgactgggctgtatcaagagtgggtgatgaatactccttcaacttcgtcaataacagaaatacgggccatgaaggcgccaaaaactgctcaaaactgctgtggtcggcattccttttaaaagccgggattgatatcgactctaacggcggcttaggcgtatatccgcgcgacatcacaagctcgtcttacacgaccacgattctgaccattcgctaa

SEQ ID NO: 56 - DNA, 789 bp, Bacillus Sp.
gtggaaaaattatactcaaagaaaagaggcgaagtcatgatgtgtaaaaagctgttcaaagccgtcctcccgtttgccctgtcattcaccatggttctgtcgttctccggtatgaatgtaaaagcgaaagaaacagaaacagcccgctacgcaaaagaaatcgcagagcttcagcagggcacgactccccaagacgttctccaatccgccaaagagcttgccaaacagaagcacgtttcaacagaagcaattctcaagcagtttcatcaagaaatcacggcagacaaggtgcaaggaaatgtaatcgcttccaaagaagggatctctgcgatgggcggatcgtcaggaaccaaaaaacttccgaaaagcacaaaaggcaatatttattacacgaactcatacacggcttattacaaccacgggcatgtcggcatgtattcatccgctgataaaattgtcgaatccgtgccgggagacggcgtccgccagattgcttataacggcagagaagtcgaagacaattcaatcgtccagaccgtaaaagtcaccgacgcccaaaaacaagccgccgctgactgggctgtatcaagagtcggtgatgagtactccttcaacttcgtcaataacagaaatacgggccatgaaggcgccaaaaactgctcaaaactgctgtggtcggcattcctcttaaaagccgggattgatatcgactctaacggcggcttaggcgtatacccgcgcgacatcacaagctcgtcctacacaaccacgattctgaccattcactaa

SEQ ID NO: 57 - DNA, 753 bp, Bacillus Sp.
atgaagtgtaagaaaatgttcaaagccgtcattccgtttgcactgatgtttgccatggttcttcccttctccggtatgaatgtaaaagccaaagaaacagaaacggcccgctacgcaaaagagatcgcggagcttcagcagggcacgaccccgcaagaagtcatccagtccgctaaagagctggccaaacagaagcatgtcacgacagaagccatcctcaagcagtttcacagcgaaatcaccgctgacaaggtgcaaggagatgtaatcgcttccaaacaaggtttatctgcgatgggcggctcgtcaggcaccaaaaaactcccgaaaagcacaaaaggcaatatttattacacgaactcatacacagcctattacaaccacggccatgtcggcatgtattctgccgctgatcaaattgtcgaatccgtaccgggtgacggcgtccggcagattgcctataacggaagagaagttgaagacaattcaatcgtccagaccgtcagcgtcaccgatgcccaaaaacaagccgccgctgactgggccgtatcacgagtcggcgacgagtactccttcaacttcgtcaataaccgaaatacaggccatgaaggcgccaaaaactgctcgaaactgctgtggtcggcgttcctcctaaaagccggaatcgacattgactctaacggcggcctgggcgtatatcctcgcgatatcacaagctcgccttatacgacaacgatcctgaccattaactaa

SEQ ID NO: 58 - DNA, 1164 bp, Bacillus Sp.
gtgaaaaaaatcatctggatacccttagtgatcatcgccgccgcagcggtcttatgcttcttctatttccgcacggaagaccctgcggaggttgatagggacacattaaatgaccctgattttctgaaagataaagaggcgctgctgtatttctccactgcggctgaccaagacacgttcggcggcggaaaaagctacgccatcttcgccgatgaaaaaggacggctttcttcttatcacatgaaggggcttgagctcggatcggccaaagtgcatgacggcagcgtgctgcttgaggacaaaaaaggaatctacaccgttcagggcggccttcacacgtataaaagagcgtaccagcatacgggagacagcgcgggatatatcgagcggacgaaaggcttttacacgctgtataattcgggctacgacaagagcggcggcagctaccgctcagagctgtaccgccagattgacggcaagtggaagcaaaacgtcatcccgcactatatccgcgcttcaggcttttttaaagatcatcttttcgcactcacgccgacagatgacgaaaaaggctatcacgtccaagacattcaggccgataaagaaaagctccatacaacatcaatcgcgacatggacgtacaaagaaggcacgtctgtcgaatcccagctcgcagcggacgacagcgccgtctgctttgtcaccagaggggaaaaagcagaccacatctatcaaatggtgaaagtcatgaaaaacagcggcgccatcaaaacgtatgacatcgccgcttataaaaatgaagaacagacgatctatgactccatgccgttcagcttcaaaaaaagctttttcatggagcggcgcagcttctatttcgttgacggcttcggaaccgtctaccgcatcaaccctgagaccggaaaaagcaaaaaagccttcaccctccccccatcacgaatgaaggccgacttcaaggagctgacccatcaaaacggaaagctgtatctgtttacgtacagctacaaaaagcccgccaaaatcgaatctttcgacctgaaaacgggcaaaaaactgaacgacctgaccatcccaaacttaaaaaacatcgtcacaccgaaaagccatctcaagctgtatgatgtgcaggtgatgggtgggttttaa

SEQ ID NO: 59 - DNA, 1164 bp, Bacillus Sp.
gtgaaaaaaatcatctggatccccttagtgatcatcgccgccgcagcggtcttatgcttcttctattttcgcacggaagatcctgcggaggttgcgagagacacattaaatgaccctgattttctgaaagataaagaggcgctgctgtatttctccactgccgctgaccaagacacgttcggcggcggaaaaagctacgccctcttcgccgatgaaaaagggcggctctcttcttatcaaatgaaggggcttgagctcggatcggccaaagtgcatgacgaaagcgtgctgctggaggacaaaaaaggaatctacaccgttcagggcggccttcacacgtataaaagagcgtaccagcatacgggagacagcgcgggatatatcgagcgggcgaaaggcttttacacgctgtataattcgggctacgacaagagcggcggcagctatcgctcagagctgtaccgccagattgacggcatgtggaagcaagacgtcattccgcactacatccgcgcttcaggcttttttaaagatcatcttttcgcgctcacgccgacagatgacgaaaaaggctatcacatccaagacattcaggccgataaagaaaagctccatacaacatcaattgcgacatggacgtataaagaaggcacgtctgtcgaatcccagctcgccgcggacgacagcgccatctgctttgtcaccagaggggaaaaagcagatcacatctatcaaatggtgaaagtcatgaaaaacagcggcgccatcaaaacatatgacatcgccgcttataaaaatgacgaacagacgatctatgactccatgccgttcagcttcaaaaaaagctttttcatggagcggcgcagcttctatttcgttgacggcttcggaaccgtctaccgcatcaaccctgagaccggaaaaagcaaaaaggccttcaagctccccgcatcaagaatgaaagccgacttcaaagaactgacgcatcaaaacggaaagctgtatctgttcacatacagctacaaaaagcccgccaaaatcgaatccttcgacctgaaaacgggcaaaaagctgaacgaccggaccatcccaaacctgaaaaacatcgtcacgccgaaaagccatctcaagctgtacgatgtgcaggtgatgggtgggttttga

SEQ ID NO: 60 - DNA, 1164 bp, Bacillus Sp.
gtgaaaaaaatcatctggatacccttagtgatcatcgccgccgcagcggtcttatgcttcttctatttccgcacggaagaccctgcggaggttgcgagagacacattaaatgaccctgattttctgaaagataaagaggcgttgctgtatttctccactgcggctgaccaagacacgttcggcggcggaaaaagctacgccctcttcgccgatgaaaaagggcggctttcttcttatcaaatgaaggggcttgagctcggatcggccaaagtgcatgacgaaagcgtgctgctggaggacaaaaaaggaatctacaccgttcaggacggccttcacacgtataaaagagcgtaccagcatacgggagacagcgcgggatatatcgaacgggcgaaaggcttttacacgctgtataattcgggctacgacaagagcggcggcagctatcgctcagagctgtaccgccagatggacggcaggtggaagcaagacgtcatcccgcactatatccgcgcctcaggcttttttaaagatcatcttttcgcgctcacgccgacagatgacgaaaaaggctatcacgtccaagacattcaggccgataaagaaaagctccatacaacatcaatcgcgacgtggacgtataaagaaggcacgtctgtcgaatcccagctcgccgtggacgacagcgctgtctgctttgttaccagaggagaaaaagccgatcacatctatcaaatggtgaaagtcatgaaaaacagcggcgccatcaaaacgtatgacatcgccgcttataaaaatgacgaacagacgatctatgactccatgccgttcagcttcaaaaaaagctttttcatggagcatcgcagcttctatttcgttgacggcttcggaaccgtctaccgcatcaaccctgagaccggaaaaagcaaaaaggccttcaccctccccgcatcacgaatgaaggccgactttaaagaactgacgcatcaaaacggaaagctgtatctgttcacgtacagctacaaaaagcccgccaaaatcgaatccttcgacctgaaaacgggcaaaaaactgaacgacctgaccatcccaaacttaaaaaacatcgtcacgccgaaaagccatctcaagctgtatgatgtgcaggtgatggatgggttttaa

SEQ ID NO: 61 - DNA, 1164 bp, Bacillus Sp.
gtgaaaaaaatcatctggatacccttagtgatcatcgccgccgcagcggtcttatgcttcttctatttccgcacggaagaccctgcggaggttgcgagagacacattaaatgaccctgattttctgaaagataaagaggcgctgctgtatttctccactgcggctgaccaagacacgttcggcggcggaaaaagctacgccctcttcgccgatgaaaaagggcggctttcttcttatcaaatgaaagggcttgagctcggatcggccaaagtgcatgacggcaacgtgctgctggaggacaaaaaaggaatctacaccgttcaaaatggtcttcacacatataaaagagcgtatcagcatacgggagacagcgccgggtatatcgaacggacgaaaggcttttacacgctgtacaattcgggctacgacaagagcggcggcagctatcgctcagagctgtaccgccagattgacggcaggtggaagcaaaacgtcatcccgcactatatccgcgcctcaggctattttaaagatcatcttttcgcgctcacgccgacagatgacgaaaaaggctatcacatacaagacattcaggccgataaagaaaagctccatacaaaatcaattgcgacatggacgtataaagaaggcgcgtcagtcgaatcccagctcgccgcggacgacggcgccgtctgctttgtcaccagaggggaaaaagcagaacacatctatcaaatggtgaaagttatgagaaagagcggcgcgatcaaaacatatgacatcgccgcttataaaaatgacgaacagacgatctatgactccatgccgttcagcttcaaaaaaagctttttcatggagcatcgcagcttctatttcgttgacggcttcggaaccgtctaccgcatcaaccctgagaccggaaaaagcaaaaaggccttcaccctccccgcatcacgaatgaaggccgactttaaagaactgacgcatcaaaacggaaagctgtatctgttcacgtacagctacaaaaagcccgccaaaatcgaatccttcgacctgaaaacgggcaaaaaactgaacgacctgaccatcccaaacttaaaaaacatcgtcacgccgaaaagccatctcaagctgtatgatgtgcaggtgatggatgggttttaa

SEQ ID NO: 62 - DNA, 1185 bp, Paenibacillus Sp.
gtgaaaaaaatcatctcgatacccttagtgatcatcgccgccgcagcggtcttatgcttcttctatttccccacggaagatcctgcggaggttgcgagagacacattaaatgaccctgattttctgaaagataaagaggcgctgctgtatttctccactgcggctgagcaagacacgttcggcggcggaaaaagctacgccctcttcgccgatgaaaaagggcggctttcttcttatcaaatgaaggggcttgagctcggatcggccaaagtgcatgacgaaagcgtgctgctggaggacaaaaaaggaatctacaccgttcaggacggccttcacacgtataaaagagcgtaccagcatacgggagacagcgcgggatatatcgaacgggcgaaaggcttttacacgctgtataattcgggctacgacaagagcggcggcagctaccgttcagagctgtaccgccagatggacggcaagtggaagcaagacgtcatcccgcactacatccgtgcttcaggcttttttaaagatcatcttttcgcgctcacgccgacagatgacgaaaaaggctatcacgtccaagacattcaagccgataaagaaaagctccatacaaactcaatcgcgacatggacgtataaagaaggcacgtctgtcgaatcccagctcgccgcggacgacagcgccgtctgctttgttaccagaggagaaaaagccgattacatctatcaaatggtgaaagtcatgaaaaacagcggcgccatcaaaacgtatgacatcgccgcttataaaaatgacgaacagacgatctatgactccatgccgttcagcttcaaaaaaagctttttcatggagcggcgcagcttctatttcgttgacggcttcggaaccgtctaccgcatcaaccctaagaccggaaaaagcaaaaaagccttcaccctccccgcatcccgaatgaaagccgacttcaaggagctgacccatcaaaacggaaagctgtatctgttcacgtacagctacaaaaagcccgccaaaatcgaatctttcgacctgaaaacgggcaaaaaactgaacgacctgaccatcccaaacttaaaaaacatcgtcacgccgaaaagccatctcaagctgtatgatgtgcaggtgatggaggggtttgagaaggaaaagcagtcatcataa

SEQ ID NO: 63 - DNA, 1185 bp, Streptococcus Sp.
gtgaaaaaaatcatctggatacccttagtgatcatcgccgccgcagcggtcttatgcttcttctatttccgcacggaagaccctgcggaggttgcgagagacacattaaatgaccctgattttctgaaagataaagaggcgctgctgtatttctccactgcggctgaccaagacacgttcggcggcggaaaaagctacgccctcttcgccgatgaaaaagggcggctttcttcttatcaaatgaaagggcttgagctcggatcggccaaagtgcatgacggcaacgtgctgctggaggacaaaaaaggaatctacaccgttcaaaatggtcttcacacatataaaagagcgtatcagcatacgggagacagcgccgggtatatcgaacggacgaaaggcttttacacgctgtacaattcgggctacgacaagagcggcggcagctatcgctcagagctgtaccgccagattgacggcaggtggaagcaaaacgtcatcccgcactatatccgcgcctcaggctattttaaagatcatcttttcgcgctcacgccgacagatgacgaaaaaggctatcacatacaagacattcaggccgataaagaaaagctccatacaaaatcaattgcgacatggacgtataaagaaggcgcgtcagtcgaatcccagctcgccgcggacgacggcgccgtctgctttgtcaccagaggggaaaaagcagaacacatctatcaaatggtgaaagttatgagaaagagcggcgcgatcaaaacatatgacatcgccgcttataaaaatgacgaacagactatctatgactccatgccgttcagcttcaaaaaaagctttttcatggagcagcgcagcttctatttcgttgacggcttcggaaccgtctaccgcatcaaccctaagaccggtaaaagcaaaaaggccttcaccctccccgcatcacgaatgaaggccgacttcaaggagctgacccatcaaaacggaaagctgtatctgtttacgtacagctacaaaaagcccgccaaaatcgaatccttcgacctgaaaacgggcaaaaaactgaacgacctgaccatcccaaacttaaaaaacatcgtcacgccgaaaagccatctcaagctgtatgatgtgcaggtgatggatgggtttgagaaggaaaagcagtcatcataa

SEQ ID NO: 64 - DNA, 1164 bp, Bacillus Sp.
gtgaaaaaaatcatctggatacccttagtgatcatcatcgctgcagcggtcttatgcttcttccattttcgcacggaagagcctgcggaggttgagagggaaacattaaatgatcctgattttctgaaagataaagaggcgctgctgtatttctccactacggctgaccaggacacgttcggcggcggaaaaagctatgctctatttgctgataaaaaaggccggctcttttcttatcaaatgaaagggctagaactcggatcggccaaagtgcatgacgaaagcgtcctgctggaggacaaaaaagggatttacactgttcaggacggccttcacacgtataaaagagcgtaccagcatacgggggacagcgcgggatatattgaccggacggaaggcttctacacgctgtataactcaggctacgacaaaagcggcggcagctatcgctcagagctgtaccgccagattgacggcaagtggaagcaagacgtcatcccgcactatatccgcgcctcaggcttttttaaagatcatcttttcgcactcacgccgacagatgacgaaaaaggctatcacgttcaagacattcaggccgataaagagaggctccatacaaatacaatcgcgacatggacgtataaagaaggcacgtctgtcgaatcccagctcgccgctgatgacagcgccgtctactttctcacaagaggagaaaaagccgaccacatctatcaaatggtgaaagtcatgagaaacagcggcgctatcaaaacgtatgacatcgcctcttataaaaatgacgaacagaccctctatgactccatgccgttcagcttcaaaaacagcttttttatggagcagcgcagcctctatttcgttgacggcttcggaaccgtataccgcatcaaccctgaaaccggaaaaagcaaaaaagccttcaccctccctgcatcaggaatgaaggctgatttcaaagacctgacccatcaaaacggaaagctgtatctcttcacgtacagctacaaaaaacccgccaaaatcgaatccttcgatctgaaaacgggcaaaaagctgaacgaccggaccatcccaaacctgaaaaacatcgtcacgccgaaaagccatctcaagctgtatgacgtgcaggtgatggatgggttttga

SEQ ID NO: 65 - DNA, 1137 bp, Bacillus Sp.
gtgatcatccttgccgcagcgggcttatgcttcttctatttccgtacggaagagcctgcggaggttgatagggaaacattaaatgaccctgattttctgaaagataaagaagcgctgctgtatttctccactgcggctgaccaagacacattcggcggcggaaaaagctatgccctcttcgccgataaaaaggggcggctctcttcttatcaaatgaaggggcttgagctcggatcggccaaagtgcatgacggcagcgtgctgctggaggacaaaaaaggaatctacaccgttcaaaatggtcttcacacatataaaagaacgtatcagcatacgggagacagcgccgggtatatcgaacagacgaaaggcttttacacgctgtacaattcgggctacgacaagagcggcggcagctaccgctccgagctgtaccgccagattgacggcaggtggaagcaaaacgtcatcccgcactatatccgcgcctcaggctattttaaagatcatcttttcgcgctcacgccgacagatgacgaaaaaggctatcacatacaagacattcaggccgataaagaaaagctccatacaaaatcaattgcgacatggacgtataaagaaggcacgtcagtcgaatcccagctcgccgcggacgacggcgccgtctgctttgtcaccagaggggaaaaagcagaacacatctatcaaatggtgaaagttatgagaaagagcggcgcgatcaaaacatatgacatcgccgcttataaaaatgacgaacagactctctatgactccatgccgttcagcttcaaaaaaagctttttcatggagcagcacagcttctatttcgttgacggcttcggaaccgtctaccgcatcaaccctgagaccggaaaaagcaaaaaggccttcaccctccccgcatcacgaatgaaggccgacttcaaggagctgacccatcaaaacggaaagctgtatctgttcacatacagctacaaaaagcccgccaaaattgaatccttcgatctgaaaacgggcaaaaaactgaacgaccggaccattcccagcctgcaagacatcgtgtcaccgaaaagccatctcaagctgtacgatgtgcaggtgatgggcgggttttga

SEQ ID NO: 66 - DNA, 1164 bp, Bacillus Sp.
gtgaaaaaactcatctggatacccttagtgatcatcatttccgcagcggtcttatgcttcttccattttcgcacggaagaccctgcggagatcacgagggatacattgaataaccccgattttctgaaagataaagaggcgctgctgtatttctccactacggctgaccaagacacgttcggcggcgggaaaagctatgctctattcgccgatgaaaaaggaaggctttcttcttatcaaatgaaggggcttgaactcggatcagccaaggtgcatgacggcagcgtgctgctggaggacaaaaaaggggtctacaccgtaaaagacggccttcacacgtataaaagagcgtatcagcatacgggggacagcgcgggatatatcgaccggacggacggcttctacacgctgtataactcaggctatgacaaaagcggcggcagctatcgctcagagctgtaccgccaaattgacggcaagtggaagcaagacgtcatcccgcactatatccgcgcctcaggctttttcaaaggccatcttttcgcgctcactccgacagatgacgaaaaaggctatcacgccaccgacattcaagcggaacaagaaaagctcagcaccaaaaccatcgcgacatggacgtataaagaaggcacgtctgtcgaatctcagctagccgcagacgataacgccatctactttctcacaagaggagaaaaagccgatcatatctatcaaatggtgaaagtcatgaaaaacagcggcgccatcaaaacatatgacatcgcctcttataaagatgacgaacaaaccctttatgactccatgccgttcagcttcaaaaaaagctttttcatggagcagcaccagctctacttcatcgacggcttcggcgccgtatatcgcatcagccccgagacgggaaaaagcaaaaaagccttcaccctccccgcagcaggaatgaaggccgatttcaaagacctgacctatcaaaacggaaagctctacctgttcacctacagcttcaaacaccccgccaaaatcgaagaattcgatctgaaaacgggaaaaaagctgaaggagcggacgatcccaaacctgaaagacatcgtcacgccgaaaagccatttaaagctttatgacgtgcaggtgatgaaggatttttga

SEQ ID NO: 67 - DNA, 1164 bp, Bacillus Sp.
gtgaaaaaactcatctggatacccttagtgatcatcatcgccgcagcggtcttatgcgtcttccattttcgcacggaagaccctgcggagatcacgagggatacattgaataaccccgattttctgaaagataaagaggcgctgctgtatttctccaccacggctgaccaagacacgttcggcggcggaaaaagctatgctctattcgccgatgaaaaaggaaggctttcttcttatcaaatgaaggggcttgaactcggatcagccaaggtgcatgacggcagcgtgctgctggaggacaaaaaaggggtctacaccgtaaaagacggccttcacacgtataaaagagcgtatcagcatacgggggacagcgcgggatatatcgaccggacggacggcttctacacgctgtataattcaggctacgataaaagcggcggaagctatcgctcagagctgtaccgccaaattgacggcaagtggaagcaagacgtcatccctcactatatccgcgcctcaggctttttcaaaggccatatttatgcgcttacgccgacagatgacgaaaaaggctatcacgccaccgacattcaagcggaacaagaaaagctcagcgccaaaaccatcgcgacatggacgtataaagaaggcacatcggtcgaatctcagctcgccgcggacgataacgccgtctactttgtcaccaggggagaaaaagccgatcacatctatcaaatggtgaaagtcatgaaaaacagcggcaccatcaaaacatatgacatcgcctcttataaagatgacgaacaaaccctttacgactccatgccgttcagcttcaaaaaaagctttttcatggagcagcaccagctctacttcatcgacggcttcggcgccgtatcccgcatcaaccccgagacgggaaaaagcaaaaaagccttcacccttcccgcagcaggaatgaaggccgatttcaaagacctgacctatcaaaacggaaagctctacctgttcacctacagcttcaaacaccccgccaaaatcgaagaattcgatctgaaaacgggaaaaaagctggaggagcggacgatcaaaaatcttcagaaaatcgtcacgccgaaaagccatttaaagctttatgacgtgcaggtgatgaaggatttttga

SEQ ID NO: 68 - DNA, 549 bp, Bacillus Sp.
atgaagaggttcataacacgtgcaagtggtaatacaatctcaaaaaagttagttttaatgatgttgccgatggttttaatgatattgatgattacaccatcgaatgatgtatcggcagcaaatctatcaaaagcaggttcactaaaaggcgtgaatttatttaatggaagttggacagttgctatacaggcagcaaatttacaatatgtttctgctgagcctttgggaaatgtaatagcaaatcgtaatgcagttaatgaatgggagaaatttgaattaattccgactggggaattatatacgtacgctttaaaagctaaaagtaatgggaagtatgtttcgtttgagccaaatggtagagtagtagcagatcgtacatcaattggggcatgggaaaaatttatcttatataatggtggggataataggatatatgtattacaagcactaagtaatggtagatatatatcagcaaatggtggtagagaattaacagctactagttatgtagctggaagttgggaaagatttgttattgtatacttctaa

SEQ ID NO: 69 - DNA, 573 bp, Bacillus Sp.
atgcatattaagggaggaatgggaatgaagaggttcataacacgtgcaagtggtaatacaatctcaaaaaagttagttttaatgatgttgccgatggttttaatgatattgatgattacaccatcgaatgatgtatcggcagcaaatctatcaagagcaggttcactaaaaggcgtgaatttatttaatggaagttggacagttgctatacaggcagcaaatttacaatatgtttctgctgagccatcgggtaatgtagtagcaaatcgtaatgcagttaatgaatgggagaaatttgaattaattccgactggggaattatatacgtttgctttaaaagcaaaaagtaatggaaagtacgtttcgtttgagccaaacggtagagtagtagcagatcgtacatcaattggggcatgggaaaaatttatcttatataatggtggagacaataggatatatgtattacaagcactaagtaatggtaggtttatatcagcaaatggtggtagagaattaactgctaatagttatgtagctggaagttgggaaagatttgttattgtatacttctaa

SEQ ID NO: 70 - DNA, 549 bp, Bacillus Sp.
atgaaaaggttcataacacgtgcaagtggtaatacaatctcaaaaaggttagttttaatggtgttgtcgatggttttaatgatagtgatgattacaccatcgaatgatgtatcggcagccaatctatcaaaagcaggttcactaaaaggcgtgaatttatttaatggaagttggacagttgctatacaggcagcaaatttacaatatgtttcggctgagccttcgggaaatataatagcaaatcgtaatgcagttaatgaatgggagaaatttgaattaatttcgactggggaattatatacgtacgctttaaaagctaaaagtaatgggaagtatgtttcgtttgagccaaatggtagagtagtagcagatcgtacatcaattggtgcatgggaaaagtttatcttatataatggtggagacaataggatatatgtattacaagcactaagtaatggtagatatatatcagcaaatggtggtagagaattaacagctactagttatgtagctggaagctgggaaagatttgttattgtatacttctaa

SEQ ID NO: 71 - DNA, 549 bp, Bacillus Sp.
atgaaaaggttcataacacgtgcaagtggtaatacaatctcaaaaaggttagttttaatggtgttgtcgatggttttaatgatagtgatgattacaccatcgaatgatgtatcggcagccaatctatcaaaagcaggttcactaaaaggcgtgaatttatttaatggaagttggacagttgctatacaggcagcaaatttacaatatgtttcggctgagccttcgggaaatataatagcaaatcgtaatgcagttaatgaatgggagcaatttgaattaatttcgactggggaattatatacgtacgctttaaaagctaaaagtaatgggaagtatgtttcgtttgagccaaatggtagagtagtagcagatcgtacatcaattggtgcatgggaaaagtttatcttatataatggtggagacaataggatatatgtattacaagcactaagtaatggtagatatatatcagcaaatggtggtagagaattaacagctactagttatgtagctggaagctgggaaagatttgttattgtatacttctaa

SEQ ID NO: 72 - DNA, 573 bp, Bacillus Sp.
atgtatattaagggaggaatggaaatgaagaggatcataacacgtgcaagtggtaatacaatctcaaaaaagttagttttaatgatgttgccgatggttttaatgatattgatgattacaccatcgaatgatgtatcggcagcaaatctatcaaaagcaggttcactaaaaggcgtgaatttatttaatggaagttggacagttgctatacaggcagcaaatttacaatatgtttctgctgagcctttgggaaatgtaacagcaaatcgtaatgcagttaatgaatgggagaaattcgaattaattccgactggagaattatatacgtacgctttaaaagccaaaagtaatgggaagtatgtttcgtttgagccaaatggtagagtagtagcagatcgtacatcaattggggcatgggaaaagtttatcttatataatggtggagacaataggatatatgtattacaagcactcagtaatggcaggtatatatcagcaaatggtggtagagaattaacagctactagttatgtagctggaagctgggaacgatttgttattgtatacttctaa

SEQ ID NO: 73 - DNA, 573 bp, Bacillus Sp.
atgtatattgagggaggaatgggaatgaagaggttcataacacgtgcaagtggtaatacaatctcaaaaaagttagttttaatgatgttgccgatggttttaatgatattgatgattacaccatcgaatgatgtatcggcagcaaatctatcaaaagcaggttcactaaaaggcgtgaatttatttaatggaagttggacagttgctatacaggcagcaaatttacaatatgtttctgctgagcctttgggaaatgtaacagcaaatcgtaatgtagttaatgaatgggagaaatttgaattaattccgactggagaattatatatgtacgctttaaaagccaaaagtaatgggaagtatgtttcgtttgagccaaatggtagagtagtagcagatcgtacatcaattgggacatgggaaaagtttatcttatataatggtggagacaataggatatatgtattacaagcactcagtaatggtaggtatatatcagcaaatggtggtagagaattaacggctactagttatgtagctggaagctgggaaagatttgttattgtatacttctaa

SEQ ID NO: 74 - DNA, 573 bp, Bacillus Sp.
atgtatattaagggaggaatgggaatgaaaaggttcataacacgtgcaagtggtaatacaatctcaaaaaggttagttttaatggtgttgtcgatggttttaatgatagtgatgattacaccatcgaatgatgtatcggcagccaatctatcaaaagcaggttcactaaaaggcgtgaatttatttaatggaagttggacagttgctatacaggcagcaaatttacaatatgtttcggctgagccttcgggaaatataatagcaaatcgtaatgcagttaatgaatgggagaaatttgaattaatttcgactggggaattatatacgtacgctttaaaagctaaaagtaatgggaagtatgtttcgtttgagccaaatggtagagtagtagcagatcgtacatcaattggtgcatgggaaaagtttatcttatataatggtggagacaataggatatatgtattacaagcactaagtaatggtagatatatatcagcaaatggtggtagagaattaacagctactagttatgtagctggaagctgggaaagatttgttattgtatacttctaa

SEQ ID NO: 75 - DNA, 549 bp, Bacillus Sp.
atgaagaggttcataactcatgcaaatggtaataagatctttaaaaagttagttttaatggttttgccaatggttctaatgataatgatgataaccccatcgaatggcgcattggcagccgaccaatcaaataccggttcactaaaaggtgtgagtctatttaatggaagttggactgttgctatacaagctgcaaatttacaatatgtttctgctgagccatcgggaaatgtggtagcaaatcctagttcagttaataaatgggagaaattcgaattaattccgactggagaattatatacgtttgctttaaaaacgaaaagtaatggaaagtatgtttcgtttgagccaaatggtagagtagtagcagatcgtacatcaattggggcatgggaaaaatttatcttatataatggtggagacaataggatatatgtattacaagcgctaagtaatggtagattcatatcagcaaatggcggtagagaattaacagctaatagttatgtagctggaagctgggaaagatttattattgtgtatttctaa

SEQ ID NO: 76 - DNA, 555 bp, Bacillus Sp.
atgggaatgaagaggttcataactcatgcaaatggtaataagatctttaaaaagttagttttaatggttttgccaatggttctaatgataatgatgataaccccatcgaatggtgcattggcagccgaccaatcaaataccggttcactaaaaggtgtgagtctatttaatgaaagttggactgttgctatacaagctgcaaatttacaatatgtttcagctgagccatcgggaaatgtggtagcaaatcctagtgcagttaatgaatgggagaaattcgaattaattccgactggagaattatatacgtttgctttaaaaacgaaaagtaatggaaagtatgtttcgtttgagccaaatggtagagtagtagcagatcgtacatcaattggggcatgggaaaaatttatcttatataatggtggagacaataggatatatgtattacaagcgctaagtaaaggtagattcatatcagcaaatggcggtagagaattaacagctaatagttatgtagctggaagctgggaaagatttattattgtgtatttctaa

SEQ ID NO: 77 - DNA, 582 bp, Bacillus Sp.
atgagtgctatatatattaagggaggaatgggaatgaagaggttcataactcatgcaaatggtaataaaatctttaaaaagttagttttaatggttttgccaatggttctaatgataatgatgataaccccatcgaatgatgcattggcagccgaccaatcaaataccgattcactaaaaggtgtgagtctatttaatggaagttggactgttgctatacaagctgcaaatttacaatatgtttctgctgagccatcgggaaatgtggtagcaaatcgtagtgcagttaatgaatgggagaaattcgaattaattccgactggagaattatatacgtttgctttaaaaacgaaaagtaatggaaagtatgtttcgtttgagccaaatggtaaagtagtagcagatcgtacatcaattggggcatgggaaaaatttatcttgtataatggtggagataataggatatatgtattacaagcgttaagtaatggtagatttatatcggcaaatggtggtagagaattaacagctaatagttatgtagctggaagctgggaaagatttgttattgtgtatttctaa

SEQ ID NO: 78 - DNA, 582 bp, Bacillus Sp.
atgagtgctatatatattaagagaggaatgggaatgaagaggttcataactcatgcaaatggtaataagatctttaaaaagttagttttaatggttttgccaatggttctaatgataatgatgataaccccatcgaatggcgcattggcagccgaccaatcaaataccggttcactaaaaggtgtgagtctatttaatggaagttggactgttgctatacaagctgcaaatttacaatatgtttctgctgagccatcgggaaatgtggtagcaaatcctagtgcagttaataaatgggagaaattcgaattaattccgactggagaattatatacgtttgctttaaaaacgaaaagtaatggaaagtatgtttcgtttgagccaaatggtagagtagtagcagatcgtacatcaattggggcatgggaaaaatttatcttatataatggtggagacaataggatatatgtattacaagcgctaagtaatggtagattcatatcagcaaatggcggtagagaattaacagctaatagttatgtagctggaagctgggaaagatttattattgtgtatttctaa

SEQ ID NO: 79 - DNA, 591 bp, Bacillus Sp.
atgatgtatatgagtgctatatatattaagagaggaatgggaatgaagaggttcataactcatgcaaatggtaataagatctttaaaaagttagttttaatggttttgccaatggttctaatgataatgatgataaccccatcgaatggcgcattggcagccgaccaatcaaataccggttcactaaaaggtgtgagtctatttaatggaagttggactgttgctatacaagctgcaaatttacaatatgtttctgctgagccatcgggaaatgtggtagcaaatcctagtgcagttaataaatgggagaaattcgaattaattccgactggagaattatatacgtttgctttaaaaacgaaaagtaatggaaagtatgtttcgtttgagccaaatggtagagtagtagcagatcgtacatcaattggggcatgggaaaaatttatcttatataatggtggagacaataggatatatgtattacaagcgctaagtaatggtagattcatatcagcaaatggcggtagagaattaacagctaatagttatgtagctggaagctgggaaagatttattattgtgtatttctaa

SEQ ID NO: 80 - DNA, 609 bp, Bacillus Sp.
atgttttacatatttggtatgatgtatatgagttttatgtatattaagggaggaatgggaatgaaaaggtttataacacgcgcaagaggtaatacagtctcaaaaaatttagttttaatggtgttgtcgatggttttaatgatatttatgattacaccatccaatgatgtatctgcagccaacctatcaaaagcagctacattaaaaggcgtgaatttatttaatggaagttggacagttgctatacaggcagcaaatttaaaatatgtttctgctgagcctttgggaaatgtaacagcaaatcgtaatgcagttaatgaatgggagaaattcgaattaattccgactggagaattatatacgtacgctttaaaagccaaaagtaatgggaagtatgtttcgtttgagccaaatggtagagtagtagcagatcgtacatcaattggggcatgggaaaagtttatcttatataatggtggagacaataggatatatgtattacaagcactcagtaatggcaggtatatatcagcaaatggtggtagagaattaacagctactagttatgtagctggaagctgggaacgatttgttattgtatacttctaa

SEQ ID NO: 81 - DNA, 462 bp, Bacillus Sp.
atgattacaccatcgaatgatgtatcggcagccaatctatcaaaagcaggttcactaaaaggcgtgaatttatttaatggaagttggacagttgctatacaggcagcaaatttacaatatgtttcggctgagccttcgggaaatataatagcaaatcgtaatgcagttaatgaatgggagaaatttgaattaatttcgactggggaattatatacgtacgctttaaaagctaaaagtaatgggaagtatgtttcgtttgagccaaatggtagagtagtagcagatcgtacatcaattggtgcatgggaaaagtttatcttatataatggtggagacaataggatatatgtattacaagcactaagtaatggtagatatatatcagcaaatggtggtagagaattaacagctactagttatgtagctggaagctgggaaagatttgttattgtatacttctaa

SEQ ID NO: 82 - DNA, 2916 bp, Bacillus Sp.
atgaaaggctattcaaaaaaaatgttagtaggggtaagttttgctagtttaatgttagggagttttcaaggggtaagtttggcagaagatactaagggagagcaagtttcttatcgaaatgtgctcaaaatggagccagtcggtgtacaactaccagtacaagaattagctcattcatcgaaagtgctcgaaagcaagtcttttgagaaaaggctacaatttgccgatttatcacaaagaccgcctgaggtaaaaaaggaaagtaagcaattagctgtagcgaaaacttatacaattgctgagttaaatcaattaagcaatcagcagttagtagatttacttgtaacaattgattgggagcagattacggggctatttcagtttaatacagacagtctagcattctatcaaaatgatagtagaatgcaggcgattattgataaattgaagcagcaaggacaagcctatacgaaggatgattcaaaagggattgagacattagtagaggtattacgttcaggattttatttaggattttataattcggaacttagtaaattaaatgaacgaagttatcatgataaatgcttacctgcattaaaagcgatggctaacaattcaaatttcaagctgggtacattagagcaaaatagagtggtatcatcatacggaaagttaataggaaacgcttcgagtgatgtggaaacgataacatcagctgcaaaaatttttaaacaatataatgataatttttctacattagtagataatctttcagctggaaatgctatttacgatattatgcaaggtgttgactacgacattcaatcgtatttgtacgatacgaggaaagcaccgaaagatacagtatggtatcagaaaatagatagttatattaatgaattaagtcgttttgcattaatgggaacgattacagcaaaaaacggttggcttattaataatggcatttattatacaggtagactcggtacgttccatagtacaggaacgaaagggttacaagttgtaacagatgcgatgaaaatttatccgtatttaggggagcaatatttcgtagctgctgagcaaatcgcaacgaattatggcggaaaagatgcaaatggtaaagtggtgaatttagatcaaataagagaagatggaaagaaaaaatatttgccaaaaacgtatacgtttgatgatggggcaattgttttaaaagctggagataaagtgacagaagaaaaagtaaaacgtttatattgggcggcaaaagaagtgaaggcacaattccatcgtacggttgaaagtgatcaacctttagaaaaaggaaatcctgatgatgtattaacgatggttatttataatagcccagcagaatatcaatttaatcgtcaattgtacggatatgaaacgaataacggtggtctttatatagaaggaacaggtacgttctttacttatgagcgtacgccagaagaaagtatttatagtttagaagaattattccgacacgagttcacacattatttacaaggtagatatgaagtaccagggttatggggacaaggaaaaatatatgaaaatgaaagattatcttggtttgaagaagggaatgctgaattttttgcaggggcaacgagaacggataatgttgtaccgagaaagagtattataggaggattatcttcaaatccagcagagcgttatacagcagagcgaacgttaaatgcaaagtatggaacgtgggatttctataattattcctttgctttacaatcttatatgtacaataagagatatgatatgtttgataaaatacatgatcttattaggaaaaatgatgtaacagcatatgatgcatatcgctctacattaagtaaagatgcgaatttaaataaagaatatcaagactatatgcaaatgctagttgataatcgtgagaaatataacgtgccattagtatcagacgattatttagcaaatcatgcaccgaaaccagtttcagatattgcggcagaaataacggcggaagcaaaattgaaaaatgtatcagtgaagaaaaataaatcacagttctttaatacattcacactacaaggaacatatacaggaactgcagcaaaaggagaatatgaagactggaaaacaattacacaaaacgttaatgatacgttaaaacgtttaagtgcaaaagaatggacaggttataaaacagtaacagcatacttcgtaaattatcgcgtgaatgcatcaggacaatttgaatatgatgttgtgttccatggtattaatacggaagaatgggcagagaataaagcaccagttgcggttataaacggtccgtatagtggaaatgtaaatgaagcaatttcatttaaaagcgacggatcaaaagatgaagacgggaaaattacttcgtataaatgggagtttggagacggtactgtaagtaatgagcaaaatccaactcacgtatatacaaaagaaggaacgtatacgacgaaattaacggtaacagacgataaaggagtaactaatactgctacagcgactgtaactgttcaaaagaaagaagataacagtgtagaaaaagaaccgaataactcattccaaacagcaaacaaactgcagttaaatcaggttttacgtgctagtttaggaaatggcgatacaagtgatttctttgaaattaatgtggagactgctaaaaaccttcaaattaacgtaacgaatgaaaataatataggaatgaactgggtactttattctgaagcagatttaaataattatgttacgtatgctcagcaacaagggaataaactagtaggtagttactacacgtatccagggaagtattatttacatgtgtatcagtatggtggtggaacagggaattatacggtggaagtaaagtag

SEQ ID NO: 83 - DNA, 2916 bp, Bacillus Sp.
atgaaaggctattcaaagaaaatgttagtaggggtaagttttgctagtttaatgttagggagttttcaagggggaagtttggcagaagatactaagggagagcaagtttcttatcgaaatgtgctcaaaatggagccagtcggtgtacaactaccagtacaagaattagctcattcatcgaaagtgctcgaaagcaagtcttttgagaaaaggctacaatttgccgatttatcacaaagaccacctgaggtgaaaaaagaaagtaagcaattagctgtagcgaaaacttatacaattgctgaattaaatcaattaagcaatcagcagttagtagatttacttgtaacaattgattgggagcaaattacggggctatttcagtttaatacagacagtctagcattctatcaaaatgatagtaggatgcaggcgattattgataaattgaagcagcaaggacaagcctatacgaaggatgattcaaaagggattgagacattagtggaggtattacgttcaggattttatttaggattttataattcggaacttagtaaattaaatgaacggggttatcatgataaatgcttacccgcattaaaagcgatagctaacaactcaaatttcaagctgggtacattagagcaaaatagagtggtatcatcatacggaaagttgataggaaacgcttcgagcgatgtggaaacgataacatcggctgcaaagatttttaaacaatataatgataatttttctacattagtagataatctttcagctggaaatgctatttacgatattatgcaaggtattgattacgacattcaatcgtatttgtacgatacgaggaaagaaccgaaagatacagtatggtatcagaaaatagatagttatattaatgaactaagtcgttttgcattaatgggaacgattacagaaaaaaacggttggcttattaataatggcatttattatacaggtagactcggtatgttccataatacaggaacgaaagggttacaagttgtaacagatgcgatgaaaatttacccgtatttaggggagcaatatttcgtagctgctgagcaaatcgcaacgaattatggcggaaaagatgcaaatggtaacgtggtgaatttagatcaaataagagaagagggaaagaaaaaatatttgccaaaaacgtatacgtttgatgatggggcaattgttttaaaagctggagataaagtgacagaagaaaaagtaaaacgtttatattgggcggcaaaagaagtgaaggcacaattccatcgtacggttgaaagtgatcaacctttagaaaaaggaaatcctgatgatgtattaacgatggttatttataatagcccagcagaatatcaatttaatcgtcaattgtacggttatgaaacgaataacggtggtctttatatagaaggaacaggtacgttctttacttatgagcgtacgctagaagaaagtatttatagtttagaagaattattcagacacgagttcacgcattatttacaaggtagatatgaagtaccagggttatggggacaagggaaaatatatgaaaatgaaaggttatcttggtttgaagaagggaatgctgaattttttgcaggggcaacgagaacggataatgttgtaccgagaaagagtattataggaggattatcttcaaatccagcagagcgttatacggcagagcgaacgttaaatgcaaagtatggaacgtgggatttctataattattcctttgctttacaatcgtatatgtacaataagagatatgatatgttcgataaaatacatgatcttattaggaaaaatgatgtaacagcatatgatgcatatcgctctacattaagtaaagatgcgaatttaaataaagaatatcaagattatatgcaaatgctagttgataatcgtgagaaatataatgtgccattagtatcagacgattatttagcgaatcatgcatcgaagcgagtttcagatattgcggcagaaataacagcggaagcaaaattgaaaaatgtatcagtgaagaaaaataaatcacagttctttaatacattcacactacaaggaacatatacaggaactacagcaaaaggagaatatgaagattggaaaacaattacacaaaacgttaatgatacgttaaaacgtttaagtgcaaaggaatggacaggctataaaacagtaacagcatacttcgtaaattatcgcgtgaatgcatcaggacaatttgaatatgatgttgtgttccacggtattaatacagaagaaggtgcagagaataaagcaccagttgcagttataaacggtccgtatagtggaaatgtaaatgaagcaatttcatttaaaagcgacggatcaaaagatgaagatgggaaaattacttcatataaatgggagtttggtgatggggcagtaagtaatgagcaaaatccaattcacgtatatacaaaagaaggaacgtatacgacgaaattaacggtaacagacgataaaggagcaactaatactgctacagcgactgtaactgttcaaaagaaagaagataacagtgtagaaaaagaaccgaataactcattccaaacagcaaacaaactgcagttaaatcaagttttacgtgctagtttaggaaatggcgatacaagtgacttctttgaaattaatgtggagactgctaaaaatcttcaaattaacgtaacgaatgaaaataatattggaatgaactgggtactttattctgaagcagatttaaataattatgttacgtatgctcagcaacaagggaataaactagtaggtagttactacacgtatcctggaaaatattatttacatgtgtatcagtatggcggggggacagggaattatacggtggaagtgaagtag

SEQ ID NO: 84 - DNA, 2838 bp, Bacillus Sp.
ttggcagaagatactaagggagagcaagtttcttatcgaaatgtgctcaaaatggagccagtcggtgtacaactaccagtacaagaattagctcattcatcgaaagtgctcgaaagcaagtcttttgagaaaaggttacaatttgccgatttatcacaaagaccacctgaggtgaaaaaagaaagtaagcaattagctgtagcgaaaacttatacaattgccgaattaaatcaattaagcaatcagcagttagtagatttacttgtaacaattgattgggagcaaattacggggctatttcagtttaatacagacagtctagcattctatcaaaatgatagtaggatgcagacgattattgataaattgaagcagcaaggacaagcctatacgaaggatgattcaaaagggattgagacattagtagaggtattacgttcaggattttatttaggattttataattcggaacttagtaaattaaatgaacggagttatcatgataaatgcttacctgcattaaaagcgatggctaacaattcaaattttaagctgggtacattagagcaaaatagagtggtatcatcatacggaaagttaataggaaacgcttcgagcgatgtggaaacgataacatcggctgcaaagatttttaaacaatataatgataatttttctacattagtagataatctttcagctggaaatgctatttacgatattatgcaaggtgttaattacgacattcaatcgtatttgtacgatacgaggaaagcaccgaaagatacagtatggtatcagaaaatagatagttatattaatgaattaagtcgttttgcattaatgggaacgattacagcaaaaaacggttggcttattaataatggcatttattatacaggtagactcggtatgttccatagtacaggaactaaagggttacaagttgtaacagatgcgatgaaaatgtatccgtatttaggggagcaatatttcgtagctgctgagcaaattgcaacgaattatggcggaaaagatgcaaatggtaaagtggtgaatttagatcaaataagagaagatggaaagaaaaaatatttgccaaaaacgtatacgtttgatgatggggcaattgttttaaaagctggagataaagtgacagaagaaaaagtaaaacgtttatattgggcggcaaaagaagtaaaggcacaattccatcgtacggttgaaagtgatcaacctttagaaaaaggaaatcctgatgatgtattaacgatggttatttataatagcccagcagaatatcaatttaatcgtcaattgtacggttatgaaacgaataacggtggtctttatatagaaggaacaggtacgttctttacttatgagcgtacgccagaagaaagtatttatagtttagaagaattattcagacacgagttcacgcattatttacaaggtagatatgaagtaccagggttatggggacaagggaaaatatatgaaaatgaaagattatcttggtttgaagaaggaaatgctgaattttttgcaggggcaacgagaacggataatgttgtaccgagaaagagtattataggaggattatcttcaaatccagcagagcgttatacggcagagcgaacgttaaatgcaaagtatggaacgtgggatttctataattattcctttgctttacaatcgtatatgtacaataagagatatgatatgttcgataaaatacatgatcttattaggaaaaatgatgtaacagcatatgatgcatatcgctctacattaagtaaagatgcgaatttaaataaagaatatcaggactatatgcaaatgctagttgataatcgtgagaaatataatgtgccattagtatcagacgattatttagcgaatcatgcatcgaagccagtttcagatattgcagcagaaataacagcggaagcaaaattgaaaaatgtatcagtgaagaaaaataaatcacagttctttaatacattcacactacaaggaacatatacaggaactgcagcaaaaggagaatatgaagattggaaaacaattacacaaaacgttaatgatacgttaaaacgtttaagtgcaaaggaatggacaggctataaaacagtaacagcatactttgtaaattatcgcgtgaatacatcaggacaatttgaatatgatgttgtgttccacggtattaatacagaagaaggtgcagagaataaagcaccagttgcagttataaacggtccgtatagcggaaatgtaaatgaagcaatttcatttacaagcgacggatcaaaagatgaagacgggaaaattacttcgtataaatgggagtttggtgatggagcagtaagtaatgagcaaaatccaactcacgtatatacaaaagaaggaacgtatacgacgaaattaacggtaacagacgataaaggagcaactaatactgctacagcgactgtaactgttcaaaagaaagaagataacagtgtagaaaaagaaccgaataactcattccaaacagcaaacaaattgcagttaaatcaagttttacgtgctagtttaggaaatggcgatacaagtgatttctttgaaattaatgtggagactgctaaaaaccttcaaattaacgtaacgaatgaaaataatattggaatgaactgggtactttattctgaagcagatttaaataattatgttacgtatgctcagcaacaagggaataaactagtaggtagttactatacgtatccagggaagtattatttacatgtgtatcagtatggcggggggacagggaattatacggtggaagtgaagtag

SEQ ID NO: 85 - DNA, 2895 bp, Bacillus Sp.
atgttagtaggggtaagttttgctagtttaatgttagggagttttcaaggggtaagtttggcagaagatactaagggagagcaagtttcttatcgaaatgtactcaaaatggagccagtcggtgtacaactaccagtacaagaattagctcattcatcgaaattgctcgaaagcaagtcttttgagcaaaggatacaatttgctgatttatcacaaagaccgcctgaggtaaaaaaggaaagtaagcaattagctgtagcgaaaacttatacaattgctgaattaaatcaattaagcaatcagcagttagtagatttacttataaccattgattgggagcaaattacggggctatttcagtttaatacagacagtctagcattctatcaaaatgatagtagaatgcaggcgattattgataaattgaagcagcaaggacaagcctatacgaaggatgattcaaaagggattgagacattagtagaggtattacgttcaggattttatttaggattttataattcggaacttagtaaattaaatgaacggagttatcatgataaatgcttacctgcattaaaagcgatagctaacaattcaaatttcaagctgggtacattagagcaaaatagagtggtatcatcatacggaaagttaataggaaacgcttcgagtgatgtggaaacgataacatcggctgcaaagatttttaaacaatataatgataatttctctacattagtagataatctttcagctggaaatgctatttacgatattatgcaaggtgttgattacgacattcaatcgtatttgtacgatacgaggaaagcaccgaaagatacagtatggtatcagaaaatagatagttatattaatgaactaagtcgttttgcattaatgggaacgattaccgcaaaaaacggttggcttattaataatggcatttattatacaggtaggctcggttcgttccatagtacaggaacgaaaggattacaagttgtaacagatgcgatgaaaatttatccgtatttaggggagcaatatttcgtagctgctgagcaaatcgcgacgaattatggcggaaaagatgcaaatggtaaagtggtgaatttagatcaaataagagaagatggaaagaaaaaatatttgccaaaaacgtatatgtttgatgatggggcaattgttttaaaagctggagataaagtgacagaagaaaaagtaaaacgtttatattgggcggcaaaagaagtgaaggcacaattccatcgtacggttgaaagtgatcaacctttagaaaaaggaaatcctgatgatgtattaacgatggttatttataatagcccagcagaatatcagtttaatcgtcaattgtacggatatgaaacgaataacggtggtctttatatagaaggaacaggtacgttctttacttatgagcgtacgccagaagaaagtatttatagtttagaagaattattccgacacgagttcacgcattatttacaaggtagatatgaagtaccagggttatggggtcaagggaaaatatatgaaaatgaaagattatcttggtttgaagaagggaatgctgaattttttgcaggggcaacgagaacggataatgttgtaccgagaaagagtattataggaggattatcttcaaacccagcagagcgttatacggcagagcgaacgttaaatgcaaagtatggaacatgggatttctataattattcctttgctttacaatcgtatatgtacaataagagatatgatatgtttgataaaatacatgatcttattaggaaaaatgatgtaacagcatatgatgcatatcgctctacattaagtaaagatgcgaatttaaataaagaatatcaagattatatgcaaatgctatttgataatcgtgagaaatataacgtaccattagtatcagacgattatttagcaaatcatgcaccgaaaccagtttcagatattgcggcagaaataacggcggaagcaaaattgaaaaatgtatcagtgaagaaaaataaatcaaagttctttaatacattcacactacaaggaacatatacaggaactgcagcaaaaggagaatatgaagattggaaaataattacacaaaacgttaatgatacgttaaaacgtttaagcgcaaaagaatggacgggctataaaacggtaacagcatacttcgtaaattatcgcgtgaatgcatcaggacaatttgaatatgatgttgtgttccacggtattaatacagaagaagatgcagagaataaagcgccagttgcggttataaacggtccgtatagtggaaatgtgaatgaagcaatttcatttaaaagcgacgcatcaaaagatgaagacgggaaaattacttcatataaatgggagtttggagacggtactgtaagtaatgagcaaaatccaactcacgtatatacaaaagaaggagcgtatacagcgaaattaacagtaacagacgataaaggagcaactaatactgctacagcgactgtaactgttcaaaagaaagaagataacagtttagaaaaagaaccgaataactcattccaaacagcaaacaaactgcagttaaatcaagttttacgtgctagtttaggaaatggagatacaagtgatttctttgaaattaatgtggagactgctaaaaatcttcaaattaacgtaacgaatgaaaataatatcggaatgaactgggtactttattctgaagcagatttaaataattatgttacgtatgctcagcaacaagggaataaactagtaggtagttactacacgtatccagggaagtattatttacatgtgtatcagtatggtggtgaaacagggaattatacggtggaagtgaagtag

SEQ ID NO: 86 - DNA, 2916 bp, Bacillus Sp.
atgaaaggctattcaaaaaaagtgttagtaggggtaagttttgctagtttaatgttagggagctttcaagggggcgcattggcagaaggtacaaagggagagcaagtttcatatcggaatgtgctcaaaatggagccagttggtgtacagttaccagtgcaagaattagctcattcctcaaaagtgctggaaaataagtcttttgagaaaaggctacaatttgctgatttatcacaaagaccgcctgaagtgaaaaaggaaagtaagcaattagctgtagcgaaaacgtatacaattgctgaattaaatcaattgagcaatcagcagttagtggatttacttgtaacaatcaattgggagcaaattactgggttatttcagtttaacaaggatagtcttgcattctatcaaaatgatagtaggatacaggcaattattgataaattgaaccagcaaggacaagcgtatacgaaagatgattcaaaagggattgagactttagtagaggtattacgatctggtttttatttaggattttatcatacagaattaagtaaactaaatgagcgaagctatcatgataaatgcttacctgcattaaaaacgattgcgaataacccgaatttcaagctcggtacattagaacaaaatagagttgtctcgtcatacggaaaattaataggaaatgcttcgagtgatgtggaaacgatcacatcagctgcaaagatttttaaacaatataatgataatttttctacattggtagataatctttcagctggaaatgcgatttacgatattatgcaaggtgttgattacgatattcaatcgtatttgtacgatacgagaaaagcaccgaaagatacagtatggtatcaaaaaattgatagctatattaatgaattaagtcgttttgctttaattggaacggtgacagcgaagaacggatggttaattaataatggtatttattatacaggtagacttggtacgttccatggtacaggaacaaaagggttgcaagttgtaacggatgccatgaaaatctatccgtatttaggagagcaatatttcgtagcagctgagcaaattgcgacgaattatggcgggaaagatgcaaatgggaacgttgttaatttagatcaaatacgagaagatggtaagaaaaaatatttaccgaaaacgtatacatttgacgatggggcaattgttttaaaagctggagataaggtgacagaagaaaaagtaaaacgtctatattgggcggcaaaagaagtgaaggctcaattccatcgtacggtggaaagtgatcaacctttagaaaaaggaaatcctgatgatgtattaacgatggttatttataatagcccagctgaatatcaatttaaccgtcaattgtacggatatgaaacgaataacggcggtctttatatagaaggaacaggtacgttctttacttatgaacgtacgccagaagaaagtatttatagtttggaagaattgttccgacatgagttcacgcattacttacaaggtagatatgaagtgccgggactttggggacaaggtaagatgtatgagaatgagagattatcttggtttgaagaagggaatgcagagttttttgcaggtgcaacgagaacagataatgttgtaccgagaaagagcattataggaggaatatcttcaaatccagcagaccgttatacggcagagagaacgttaaatgcaaagtatgggacgtgggatttctataattattccttcgctttacaatcgtacatgtacaataagagatatgatatgtttgacaaaattcatgatcttattagaaaaaatgatgtaacagcatatgatgcataccgctctgctttaagtaaagatgcgaatttaaataaagagtatcaagactatatgcaaatgttagtagataaccgtgagaaatataatgttccattagtatcagatgattatttagcaactcacgcgccaaaaccagtttcagatattgcggcagaaattacagcagaagcaaaattaaataatgtatcagttaagaaaaataaatcgcagttctttcatacatttacactacaagggacgtacacgggtactactgcaaaaggagaatatgaagactggaaaacaattacacaaaacgtgaatgatacgttaaaacgtttaagtgcaaaagaatggacaggctataaaacagtaacagcttacttcgtaaattaccgtgtgaatacatcaggacaatttgaatatgatgttgtattccatggtattaatactgaagaaggcgctgtgaataaagcgccagttgcggttataaatggtccatatattggaaatataagcgaagcaatttcgtttaaaagcgatggctcaaaagatgaagatgggaaaattgtttcttataaatgggagtttggtgatggtacggtaagtaatgaacaaaatccgactcacgtgtatacaaaagaaggaacgtatacagcgaaattaacagtaacagatgacaaagggttaacgaatactgttacaacgaatgtaacggttcaaaagaaagaagataatagtatagaaaaagaaccgaataattcattccagacagcaaataaactccaattcaatcaagttttacgtgctagtttaggaaatggtgatacgagtgatttctttgaaataaatgtggaaacagcgaaaaacctgcaaattaatgtaacgaaggaaaataatatcggagtaaattgggttctttattcagaagcagatttaaataattatattacgtatgcacagcaagaggggaataagttagtaggaagttattacacgtatccaggaaagtattatttacatgtgtatcagtatggcgggggaacagggaattatacggtagaagtgaaatag

SEQ ID NO: 87 - DNA, 2916 bp, Bacillus Sp.
atgaaaggctattcaaaaaaagtgttagtaggggtaagttttgctagtttaatgttagggagttttcaagggggcgcattggcagaaggtacaaagggagagcaagcttcatatcggaatgtgctcaaaatggaaccagttggtgtacaattaccagtacaagaattagctcattcatcaaaagtacttgaaaataagtcttttgagaagaggttacaatttgctgatttgtcgcaaagaccgcctgaattgaaaaaggagagtaagcaattagctacagcaaaaacttatacaattgctgagttaaatcaattaagcaatcagcagttagtagatttacttgtaacaatcgattgggagcaaattactgggctatttcagtttaacaaggatagtcttgccttctatcaaaatgatagtaggatacaggcaattattgataaattgaagcagcaaggacaagattatacgaaagatgattccaaagggattgaaactttagtagaggtattacgatcaggattttatttagggttttatcatacagaattaagtaaactaaatgagcggagctatcatgataaatgcttacctgcattaaaaacgattgcgaataacgcgaatttcaaactcggtacgttagaacaaaatagagttgtatcatcatacggaaaattaataggaaatgcttcgagtgatgtggaaacgataacatcagctgcaaagatttttaaacaatataatgataatttttctacatgggtagataatctttcagctggaaatgcgatttacgatattatgcaaggcgttgactacgatattcaatcgtatttgtacgatacgagaaaagcaccgaaagatacagtatggtatcaaaaaattgatagctatattaatgaattaagtcgttttgctttaattggaacggtgacagagaagaatggttggcttattaataatggtatttattatacaggtagacttggtacgttccatagtacagggacgaaagggttgcaagttgtaacagatgccatgaaaatgtatccgtatttaggggagcaatatttcgtagcggctgagcaaattgcgacgaattatggcgggaaagatgcaaatggaaacgttgtgaatttagatcaaatacgagaagatggtaagaagaaatatttaccgaaaacgtatacatttgacgatgggacaattgttttaaaagctggagataaagtgacagaagaaaaagtaaaacgtctatattgggcggcaaaagaagtgaaggctcaattccatcgtacggttgaaagtgaccagccgttagaaaaagggaatgctgatgatgtattaacgatggttatttataatagcccagctgaatatcaatttaaccgtcaattgtacgggtatgaaacgaataacggcggtctttatatagaaggaacaggtacgttctttacttatgagcgtacgccagaagaaagtatttatagtttagaggaattgttccggcacgagttcacacattacttacaaggtagatatgaagtgccaggactttggggacaaggtaagatttatgagaatgagagattatcttggtttgaagaaggcaatgcagagttttttgcaggtgcaacgagaacagataatgttgtaccgagaaagagcattataggaggaatatcttcaaatccggcagaacgttatacggcagagagaacgttaaatgcaaagtacggaacatgggatttttataattattccttcgctttacaatcgtacatgtacaataagagatatgatatgtttgacaaagttcatgatcttattagaaaaaatgatgtaacagcatatgatgcatatcgctctgcattaagtaaagatgcgaatttaaataaagagtatcaagactatatgcaaatgttagtcgacaatcgtgataaatataatgttccattagtatcagatgattatttagcaactcacgcaccgaaaccagtctcagatattgtggcagaaattacggcagaagcgaaattaagtaatgtatcagttaagaaaaataaatcacagttctttcatacatttacactgcaaggaacatatacaggtacgactgcaaaaggagaatatgaagactggaaatcaattacacaaaacgtaaatgatacgttaaaacgtttaagtgcaaaagaatggacaggctataaaacagtaacagcttatttcgtaaattaccgtgtgaatgcatcaggacaatttgaatatgacgttgtattccatggtatgaatacagaagaaggcgctgtgaataaagcaccagttgcggttataaatggtccctatagtgggaatgtaaatgaagcaatttcgtttaaaagcgatggatcaaaagatgaagatggaaaaattgttgcttataaatgggagtttggtgatggtactgtaagcaatgaacaaaatccaactcacgtgtatacaaaagaaggaacatatacagcgagattaacagtaacagatgataaagggttaacgaatactgttacaacgaatgtaacagttcaaaagaaagaagataacagtgtagaaaaagaaccaaacaattcattccagacagcaaatacactgcaattcaatcaagttttacgcgcaagtttaggaaatggtgatacgagtgatttctttgaaataaatgtggaaacggcgaaaaatctgcaaattaatgtaacgaaggaaaataatatcggagtaaactggattctttattcggaagcagatttaaataactatattacgtatgcccagcaagaggggaataagttagtaggaagttactacacgtatccaggtaagtattatttacatgtgtatcagtatggtggtggatttgggaattatacggtagaagtgaagtag

SEQ ID NO: 88 - DNA, 2916 bp, Bacillus Sp.
atgaaaggttattcaaaaaaagtgttagtaggggtaagttttgctagtttaatgttaagtagttttccggggaccatattggcggaggatactaaggaagagcaagtttcttatcgaaatgtgcttaaaatggagccggttggtgtgcaattgccagtgcaagaattggctcattcatcgaaagtgctagaaaataaatcttttgagaaaaggctacaatttgctgatttatcgcaaagaccgcctgaagtccaaaaggaaagtaagcagttagctgcggcgaaaacttatacaatagctgaattaaatcaattaagcaatcaggcgttggtagatttacttgtaacaattgattgggagcaaattacggggctatttcagtttaataaagacagtctagcattctatcaaaatgatagtaggatgcaggcgattattgataaattgaagcagcaaggacaagcttatacgaaggatgattcaaaagggattgaaacattagtagaggtattgcgctctgggttttatttagggttttatcatacagaactaagtaaacttaatgaacgaagctatcatgacaagtgcttacctgcattaaaatcgatttcccaaaacccaaatttcaaactcggtacgttagaacaaaataaagttgtatcatcatatggaaaattaataggaaatgcttctagtgatgcggaaacgatttcatcggttgcgaacattttcaaacaatataatgataatctttctacatttatagataatcgttcagcaggtaatgcagtatacgatattatgcaaggtgtagattatgatattcagtcgtatttgtacgatacgaataaagcaccgaaagatacaatgtggtatcaaaaaatagatagttatattaatgagttaagtagatttgcgttaataggaacagttacagcgaaaaacggatggcttattaataatggcatttattatacaggcagactcggtacgttccatagtacagggacgaaaggattgcaagttgtaacagatgcgatgaaagtctatccgtatttaggggagcaatatttcgtagcagctgagcaaattacgacgaattatggcgggaaagatgcaaatggtaacgttgttgatttagatcaaatacgagaagatggtaagaaaaagtatttgccaaaaacgtatacattcgatgatggagcaattgttttaaaagctggagataaagtgactgaggaaaaagtaaaacgtctatattgggcagcgaaagaagtaaaggcacaatttcatcgtacagttgaaagtgaccagccgctagaaaaaggaaatcctgatgatgtgttgacgatggttatttataatagcccagctgaatatcaatttaatcgtcaattatacggatatgaaacaaataatggtggtatttatatagaaggaacaggaacgttctttacttatgaacgtacaccgcaggaaagtatttatagtttagaagaattattccgacatgagttcacgcattacttacaaggtagatatgaagtgccaggactttggggacaaggtaaattatatgaaaatgagagattatcttggtttgaagaagggaatgctgagttctttgcaggggcaacgagaacggataatgttgtaccgagaaagagcattataggaggactatcttcaaatccagcagaacgttatacggcagagcgaacgttaaatgcaaagtatggaacgtgggatttctataattattccttcgctttacaatcatatatgtacaataagagatatgatatgtttgacaaaattcatgatcttattaggaaaaatgatgtgacagcatatgatgcataccgctctgctttaagtaaagatgcgaatttaaataaagagtatcaagactatatgcaaatgttagtagacaatcgtgagaaatataatatcccattagtatcagatgattatttagcaactcatgcaccgaaaccagtttcagatattgccgcagaaattacagcggaagcaaaattaagtaatgtatcagtaaagaaaaataaatcacagttctttaatacatttacactgcaaggaacgcatacaggtactgctgcaaaaggagaaaatgaagactggaaaacaattacgcaaaacgttaatgatacgttaaaacgtttaagtgcaaaagaatggacaggctataaaacagtaacagcttactttgtgaattaccgtgtaaatgcatcagggcaatttgagtatgacgttgtgttccatggtattaatacagaagaaggtgcagtgaataaagcgccggtcgcggttattaatggtccgtatagcggaaatgtgaatgaagcaatctcgtttaaaagtgatggatcaaaagatgaagatggaaaaattacttcttataaatgggagtttggcgatggtactgtaagtagtgaaaaaaatccaactcacgtatatacaaaagaaggaacgtatacagcgaaattaacagtaacagacgataaaggagcagctaatacgaatacaacgagtgtaactgttcaaaagaaagaagataacagtgtagaaaaagagtcgaataatacatttaaaacagcgaataaactgcagttaaatcagctgttacgtgcaagtttagggaacggtgatacaagtgattactttgaaataaatgtagaaactgcgaaaaaccttcaaattaacgtaacgaaggaaaataatattggggtaaactgggttctttattcagaagcagatttaaataattatgttacgtatgctcagcaacaaggaaataagttagtaggtagttactatacgcatccagggaagtattatttacatgtatatcagtacggcgggggaacagggaattatacggtagaagtgaaatag

SEQ ID NO: 89 - DNA, 2916 bp, Bacillus Sp.
atgaaaggttattcaaaaaaagtgttagtaggggtaagttttgctagtttaatgttaagtagttttccggggaacatattggcggaggatactaaggaagagcaagtttcttatcgaaatgtgcttaaaatggagccggttggtgtgcaattgccagtgcaagaattagctcattcatcgaaagtgctagaaaataaatcttttgagaaaaggctacaatttgctgatttatcgcaaagaccgcctgaagtccaaaaggaaagtaagcagttagctgcggcgaaaacttatacaatagctgaattaaatcaattaagcaatcaggcgttggtagatttacttgtaacaattgattgggagcaaattacggggctatttcagtttaataaagacagtctagcattctatcaaaatgatagtaggatgcaggcgattattgataaattgaagcagcaagggcaagcttatacgaaagatgattcaaaagggattgagacattagtagaggtattgcggtctgggttttatttaggtttttatcatacagaattaagcaaactaaatgagcgaagctatcatgacaagtgcttacctgcattgaaaacgattgcccaaaatccggattttaaactaggtacattagaacaaaataaagtcgtatcattatatgggaaattaataggcaacgcttctagtgatgcagaaacggttacatcggctgcgaacattttcaaacaatataatgataatctttctatatttatagataaccgttcagtaggtaatgcagtgtacgatattatgcaaggtgtagattatgatattcaatcttatttatatgacacggaaaaggcgccgaaagatacactgtggtatcaaaaaatagatagttatattaatgaattaagtaggtttgcgttaattggaacagttacagcgaaaaatggatggcttattaataatggaatctattatataggtagactcggtacgttccatagtacagggacgaaaggattgcaagttgtaacggatacgatgaaactctatccgtatttaggtgagcaatatttcgtagcggctgagcaaattacgacgaattatggcgggaaagatgcgaatggtaaagtggttgatttagatcaaatacgagaagaggctaagaaaaaatatttgccgaaaacgtatacgtttgatgatgggacaattgtgttaaaagctggagataaagtgactgaggaaaaagtaaaacgtctatattgggcagcgaaagaagtaaaggcacaatttcatcgtacagttgaaagtgaccagccgctagaaaaaggaaatcctgatgatgtgttgacgatggttatttataatagcccagctgaatatcaatttaatcgtcaattatacggatatgaaacaaataatggtggtatttatatagaaggaacaggaacgttctttacttatgaacgtacacccggggagagtatatatagtttagaagagttattccgacatgaattcacgcattatttacaaggtagatatgaagtgccaggactttggggacaaggtaaattatatgaaaatgagagattatcttggtttgaagaagggaatgctgaattttttgcaggtgcaacgagaacggataatgttgttccaagaaagagcatgataggaggattatcttcaaatccagcagaacgttatacggcagagcggacattaaatgcaaagtatggaacttgggacttttataactattcctttgctttacaatcttatatgtacaataagagatatgatatgtttgataaaattcatgatcttattagaaagaatgatgtaacagcatatgatgcatatcgctctgctttaagtaaagatgcaaatttaaataaagaatatcaagactacatgcaaatgttagttgataatcgtgataaatataatgttccgctcgtatcagacgattatgtagcaactcatgcaccgaaaccagtttcagatattgcggcagaaattacagcggaagcgaaattaaagaatgtatcggtaaagaaaaataaatcacagttctttaatacatttacactgcaaggaacgtatacaggtactgctgcaaaaggagaaaatgaagactggaaaacaattacgcaaaacgttaatgatacgttaaaacgtttaagtgcaaaagaatggacaggctataaaacagtaacagcgtactttgtgaattatcgtgtgaatgcatcaggacagtttgaatatgatgttgtgttccacggcattaatacagaagaaggtgcagagaataaagcgccagtttcggtaataaatggtccgtatagcggaaatgtgaatgaagcaacctcgtttaaaagcgatggatcaaaagatgaagatgggaaaattgcttcttataaatgggagtttggcgatgatactgtaagtagtgaacaaaatccaactcacgtatatacaaaagaaggaacgtatacagcgaaattaacagtaacagacgataaaggagcagctaatacgaatacaacgagtgtaactgttcaaaagaaagaagataacagtgtagaaaaagagtcgaataatacatttaaaacagcgaataaactgcagttaaatcagctgttacgtgcaagtttagggaacggtgatacaagtgattactttgaaataaatgtagaaactgcgaaaaaccttcaaattaacgtaacgaaggaaaataatattggggtaaactgggttctttattcagaagcagatttaaataattatgttacgtatgctcagcaacaaggaaataagttagtaggtagttactatacgcatccagggaagtattatttacatgtatatcagtacggcgggggaacagggaattatacggtagaagtgaaatag

SEQ ID NO: 90 - DNA, 3015 bp, Bacillus Sp.
atgtgtgaacgttcccttattttttctcaatacagaataaaaagtaagaatagtaaaataatggtgcgggacactaaaaaatgtaaggtaggggagagcatgaaaggctattcaaaaaaagtgttagtaggggtaagttttgctagtttaatgttagggagttttcaagggagcacattggcagaaagtaaaaagggagagcaagtttcttatcggaatgtgctaaaaatggaaccagttggtgtgcaactgccagtgcaagaattagctcattcatcaaaagtgcttgaaaataagtcttttgagaaaaggctacaatttgctgatttgtcgcaaagaccacctgaagtaaaaaaagaaagtaagcaattagctgcagcgaaaacttatacaattgctgaactaaatcaattaagcaatcagcagttagtagatttacttgtaacaattgattgggagcaaattacgggtctatttcaatttaataaggatagtcttgcattctatcaaaatgatagtaggatgcaggcaattattgataaattgaagcagcaaggacaagtttatacgaaagatgactccaaagggattgagactttagtagaagtattacgttcagggttttatttaggattttatcatacagaattaagtaaactaaatgagcggagctatcatgataaatgcttacctgcattaaaaacgattgcgaataacccgaatttcaaactcggtacgttagaacaaaatagagttgtatcatcatacggaaaattaataggaaatgcttcgagtgatgtggaaacgataacatcagctgcaaagatttttaaacaatataacgataatttttctacattggtagacaatctttcagctggaaatgcgatttacgatattatgcaaggtgttgattacgacattcaatcgtatttgtacgatacgagaaaagcaccgaaagatacagtatggtaccaaaaaattgatagctatattaatgaattaagtcgttttgctttaattggaacggtgacagagaagaatggttggttaattaataatggtatttattatacaggtagacttggtacgttccatagtacaggaacgaaaggattgcaagttgtaacagacgcgatgaaaatgtatccgtatttaggagagcaatatttcgtagcggctgagcaaatcgcgacgaattatggcgggaaagatgcaaatggaaatgttgttaatttagatcaaatacgagaagacgggaagaaaaagtatttgccgaaaacgtatacgtttgatgatggggcaattgttttaaaggctggagataaagtgacagaagaaaaagtaaaacgtctatattgggcggcaaaagaagtaaaggcacaattccatcgtacagttgaaagtgatcaacctttagaaaaaggaaatcctgatgatgtattaacgatggttatttataatagtccagctgaatatcaatttaatcgtcaattgtacggatatgaaacgaataacggtggcctttatatagaaggaacaggtacgttctttacttatgaacgtacgccagaagaaagtatttatagtttagaagaattgttccgacatgagtttactcattacttacaaggtagatatgaagtaccagggctttggggacaaggtaagatgtatgagaatgagagattatcttggtttgaagaagggaatgcggagttttttgcgggggcaacgagaacggataatgttgtaccgagaaagagcattataggaggaatatcttcaaatccagcagaacgttatacggcagagcgaacgttaaatgcaaagtatggaacgtgggatttctataattattccttcgctttacaatcgtatatgtacaataagagatatgatatgtttgacaaagttcatgatcttattagaaaaaatgatgtaacagcatatgatgcataccgttctactttaagtaaagatgcgaatttaaataaagagtatcaagattatatgcaaatgttagtcgataaccgtgagaaatttaatgttccattagtatcagatgattatttagcaactcacgtaccaaaaccagtttcagatattgcggcagaaattacagcagaagcaaaattaagtaatgtatcagttaagaaaaataaatcacagttctttaatacatttacactgcaaggaacgtatacaggtactactgcaaaaggggaatatgaagactggaaaacaattacacaaaacgtaaatgatacgttaaaacgtttaagtgcaaaagaatggacaggctacaaaacagtaacagcttactttgtgaattatcgtgtgaatgcatcagggcaatttgaatatgatattgtgttccatggtatgaatacagaagaaggtgctgtgaataaagcaccagttgcgattataaatggtccatatagcggaaatgtaaatgcagcaatatcgtttaaaagcgatggatcaaaagatgaagatggaaaaattgttgcttataaatgggagtttggtgatggtactgtaagcaatgaacaaaatccaactcacgtgtatacaacagaaggaacgtacacggcaaaattgacagtaacagacgacaaaggattaacgaatactgttacaacgaatgtaacggttcaaaagaaagaagataacagtgtagaaaaagagccgaataattcattccaaacagcaaataaactgcaattaaatcaagttttacgtgctagtttaggaaatggtgatacgagtgattactttgaaattaatatcgaaacggcgaaaaacctacaaattaatgtaacgaaggaaaataatatcggagtaaactgggttctttattcagaagcggatttaaataattatgttacgtatgcccagcaagaaggaaataagttagtaggaagttactacacgtatccaggaaaatattatttacatgtgtatcagtatggcgggggaacagggaattatacggtagaagtgaaatag

SEQ ID NO: 91 - DNA, 3015 bp, Bacillus Sp.
atgtgtgaacgttcccttattttttctcaatacagaataaatagtcagaatagtaagatgatggagcgggacactaaaaaatgtaaggtaggggagagtatgaaaggttattcaaaaaaagtgttagtaggggtaagttttgttagtttaatgttagggagttttcaaggaaacatatcggcagaagatactaagggagagcaagtttcttatcgaaatgtgcttaaaatggagccggttggtgtgcaattgccagtgcaagaattagctcattcatcgaaagtgctagaaaataaatcttttgagaaaaggctacaatttgctgatttatcgcaaagaccgcctgaagtccaaaaggaaagtaagcagttagctgcggcgaaaacttatacaatagctgaattaaatcaattgagcaatcaggcgttggtagatttacttgtaacaattgattgggagcaaattacggggctatttcagtttaataaagacagtctagcattctatcaaaatgatagtaggatgcaggcgattattgataaattgaagcagcaagggcaagcttatacgaaagatgattcaaaagggattgagacattagtagaggtattgcggtctgggttttatttaggtttttatcatacagaattaagcaaactaaatgagcgaagctatcatgacaagtgcttacctgcattgaaaacgattgcccaaaatccggattttaaacttggtacattagaacaaaataaagtcgtatcattatatgggaaattaataggaaacgcttctagtgatgcagaaacggttacatcggctgcgaacatttttaaacaatataatgataatctctctacatttatagataatcgttcagcaggtaatgcagtgtacgatattatgcaaggtgtagattatgatattcaatcttatttatatgacacggaaaaggcgccgaaagatacaatgtggtatcaaaaaatagatagttatattaacgaattaagtaggtttgcgttaattggaacagttacagcgaaaaacggatggcttattaataatggaatctattatacaggtagactcggtacgttccatagtacaggaacgaaagggctgcaagttgtaacggatgcgatgaaactctatccgtatttaggtgagcaatatttcgtagcagctgagcaaattacgacgaattatagcggaaaagatgcgaatggtaaagtggttgatttagatcaaatacgggaagaggcaaagaaaaaatatttgccgaaaacgtatacgtttgatgatggggcaattgtgttaaaagctggagataaagtgactgaggaaaaagtaaaacgtctatattgggcagcgaaagaggtaaaggcacaatttcatcgtactgttgaaagtgaccagcctttagaaaaaggaaatcctgatgatgtgttgacgatggttatttataatagcccagctgaatatcaatttaatcgtcaattatacggatatgaaacaaataatggtggtatttatatagaaggaacaggaacgttctttacttatgaacgtacaccacaggagagtatatatagtttagaagagttatttcgacatgagttcacgcattatttacaaggtagatatgaagtgccaggattttgggggcaaggtaagttttatgaaaatgagcgattatcttggtttgaagaagggaatgctgaattttttgcaggtgcaacgagaacggataatgttgttccaagaaagagcatgataggaggactatcttcaaatccagcagaacgttatacggcagagcgaacgttaaatgcaaagtatggaacttgggacttttataactattcctttgctttgcaatcttatatgtacaataagagatatgatatgttcgataaaattcatgatcttattagaaagaatgatgtaacagcatatgatgcatatcgctctgctttaagtaaagatgcaaatttaaataaagaatatcaagactacatgcaaatgttagttgataatcgtgataaatataatgttccgctcgtatcagacgattatgtagcaactcatgcaccaaaaccagtttcagatattgcggcagaaattacagtggaagcaaaattaagtaatgtatcagtaaagaaaaataaatcacagttctttaatacatttacactacaaggaacatatacaggaactgcagcaaaaggagagtatgaagactggaaaacaattacacaaaacgttaacgatacgctaaaacgtttaagtgcaaaagaatggacaggctataaaacagtaacagcatacttcgtaaattatcgtgtgaatgcatctgggcaatttgaatatgatgttgtattccacggtattaatacggaagaaggtacagagaataaagcaccagtagcagttataaatggtccgtacaatggaaacgtgaatgaagcgatctcgtttaaaagcgatggatcaaaagatgaagatgggaaaattgcttcttataaatgggagtttggtgatggtactgtaagtaatgaacaaaatccaactcacgtttatacaaaagaaggaacgtatacagcgaaattgacagtaacagatgataaaggagcaacgaatactaatacaacaagcgttactgttcaaaagaaagaggataacagtatagaaaaagaaccaaacaattcattccaaacagcaaataaactccagttaaatcaagttttacgtgctagtttaggaaacggtgatacaagtgattactttgaaataaatgtagaaactgcgaaaaaccttcaaattaatgtaacgaaggaaaataacattggggtaaactgggttctttattcggaagcagatttaaataattatgttacgtatgcccagccgcaaggaaataaattagtgggcagctactatacgtatccagggaaatattatttacatgtatatcagtatggtgggggaacagggaattatacggtagaagtgaagtaa

SEQ ID NO: 92 - DNA, 2919 bp, Bacillus Sp.
atgagagattattcaaaaaaagtgttagctggggtaagtttgattactttcatgttaggtagttttcaaggggaggcgctagcgaaagacaataaaaatgataaagcgcattcctatcgaaacgtattgcgaatggagccaactggtgtacagttaccgttacaagaactagcgcattcatcaaatgtattagaaaataagtcttttgagaaaaggttacaattatcagatttatcacagcgtccaccagaggtaatgaaagaaacaaaacaagaagcaccagcaaaaaaatatacaattgcagaattaaatcaattaagcaatcaacaattagtagatttacttgtaacaattaattgggaacaaatttcgggtcttttccaatttaataatgatagccttgcattctatcaaaatgatagtcggatgcaagcaattattgataaattagcacagcaaggaaaaacatatacaaaggatgattcaaaaggaattgaaacattggtagaagtgttacgatcaggattttatttagggttttatcataatgaattaagcaaactaaatgagcgtagctatcatgataaatgcttacctgcattaaaactaattgcgaaaaaccctaattttaagttaggtacatctgaacaagatagagtagtatcttcatacgggaagttaatcgggaatgcctccagtgatccggaaatagtttcacttgcaacgccgatttttaaacaatataacgataaccttccgacgtatgttgatagtcgttctgcaggaagtgctgtatacgatattatgcagggaatagattatgacatacaatcttatttatatgatacgagaaaagagccaaaagatacgatgtggtataaaaagatagatggctatattaatgagctaagtcgttttgcattaattggtacggttacggataaaaatggatggctcattaataatggattgtattatacaggaaggcttgggatgttccatactacttcaacaaaaggtttgcaagttgtaacggaagcgatgaaagtgtatccgtatttaagtgaacaatactttgtagctgctgaacaaatcactacgaattacggcgggaaggacgcaaatgggaaaacaattgatctagaccaaatacgtgaagatggaaagaaaaagtacttacctaaaacgtatacatttgatgatggagcgattgtattgaaagcgggggataaagtaacagaagagaaagtaaaacgtttatactgggcggctaaagaagtgaaggcccaatttcaccgtacagttgaaagcgataaaccacttgaaaatggaaatccagacgatgtgttaacaatggttatatataatagtccagctgaatatcaatttaaccgtcaattatatggatatgaaacaaataatggtggtctttatatcgaaggaacaggaacgtttttcacatatgaacgtacaccagaggagagtatatatagtttagaagaattgttccgtcatgaatttacacattatctacaaggaagatatgaagtgcccggcctgtggggagaaggtaaaatctacgaagatgagcgcttatcttggtttgaagaaggaaatgctgagttttttgcaggttcaactagaacagataatgttgttccaagaaagagtattataggagggttatcttctaatccggcagatcgttacacagcagaacaaacattgaatgcaaaatacggaacgtgggatttttataattactcctttgcgctgcaatcttatatgtataataagcggtatgatatgtttgataagattcacgatttgattcggaaaaatgatgtatcaggatatgatgcataccgcttagcgttaagtaaagattcagggctaaacaaagaatatcaagattatatgcaaatgttagtagataatcgcgataaatataatgtcccattagtatcggataattatttagcaaaacatgcactgaaacctgtttcagatattgaggcggatattacagcagaagcgaaattaaaagacgtcaaagtgacaaagcataaatcacaatttttcaatacattcacactgcaaggaacatatacaggaggcactgcaaaaggagaatatgaagactggaaaacgataatacaaacggtgaatgattcattgaaacgtttagcagaaaaagagtggacaggctataaaacagtaacagcttattttgttaattatcgggtcaatgcatctggtcaatttgaatatgatcttgtgtttcacggtataaatacggaagaaagtacagggaataaagcgccggttgctgttataaatggtccatatagcgggaatgtaaatgaagcaatttctttcaagagtgacggttcaaaagacgaagatggaaaaatagctgcttataaatgggaatttggggatgggcaattaagtaatgagaaaaatccatctcatgtatatacaaaagaaggaacgtatacagtgaaattatcagtaacagatgataaaggagcaactgctactgcaacaacaaatgtaacagttcaaaagaaagatactggtagtgtagaagcagaaccgaacaattcatttgaaacagcaaataaactatcactgaataagctattacgtggtagtttaagtgacggagatgaaaatgatttctttgaaattaacgttgagactgcaaaaaatctccaaatcaacgtgacgaatgaaaataatcttggtatgaactgggtgttatactctgaagcagatttaaataattatattacctatgctcagcgagaaggaaataaactagtagggaattattatacgtacccaggaaaatactatttacatgtatataagtatagtggtggatcgggaaattatacggtagaagtgaagtaa

SEQ ID NO: 93 - DNA, 2919 bp, Bacillus Sp.
atgaggggttattcaaaaaaattgttaactggagtaagtttaattgctttcatgttaggtagtttccaaggagaggtactagcgaaagatgataagaaagagaacactcactcttatcgaaatgtattacgaatggaaccgagtggtgagcgagtaccgttacaggaactagcacattcatcaaacgtattagaaaataagtcttttgagaaaaggttacaattagcagatttatctcagcgtccaccagaggctatgaaagaagcgaaacaagcagtaccagcaaaaaaatatacaatagctgagttaaatcaattaagtaatcaaaatttagtagatttgcttgtgacaattaattgggagcaaatttcagggctttttcaatttaataatgatagcctagccttttatcaaaatgatagtcgaatgcaggcgattattgataaattagcacagcaaggacaaacgtatacaaaagatgactcaaaaggaatagaaacattagtagaagtattgcgttcaggattctatttaggattttatcataatgaattaagtaaactatatgagcgtagttatcgtgataaatgtttaccagctttaaaggcaattgcgaaaaatcccaattttaagctaggtacatctgagcaaaataaagtagtgtctttatatgggaagttaatcgggaatgcctctagtgatgcggaaataatttcacttgctgcaccgatttttaaacagtttaacgataacctttctacgtatgttggcagtcgttcagcagggagtgctgtatacgacttaatgcaaggcatagattatgatatacaatcgtatttatatgatacggaaaaagggccgaaagatacgatgtggtatagaaagatagatagctatattaatgagttaagtcgttttgcactaattggtacagttacagatcaaaatggctggcttattaacaatgggttgtattatacaggtagacttggaatgttccatagcacgcctacaaaagggctgcaagttgtaacggaagcactgaaagtatatccatatttaagtgaacaatactttgtcgcggcagaacaaattactacgaattatggtggaaaggatgcgaatggaaaagtaatagatttagatcaaattcgtgaagatggaaagaaaaaatatttaccaaaaacgtatacatttgatgatggtgcaattgtcttaaaagcaggagacaaagtaacagaagaaaaagtaaaacgtttatattgggcagcgaaagaagtaaaggcacagttccatcgtacggttgaaagtgataagtcacttgaacagggaaatccagatgatgtactaacaatggttatatataatagcccggaagaatatcaatttaatcgtcaactatatgggtatgaaacgaacaatggtggcatttatattgaagggacggggactttctttacttatgaacgtacacctgaggagagcatatatagtttagaagaattattccgtcatgaatttacacattatttacaaggaagatatgaagtgccaggtctttggggacaagggaagttttatgaaaacgaacgcttatcttggtttgaagaaggaaatgcagagttttttgcaggggcaacgagaacagataatgttgttccgagaaagagtattataggagggctatcttctaatccagcagatcgttacacagcagaaaaaacgttgaatgcaaaatacggaacgtgggatttttataattattccttcgcattacaatcttatatgtataacaagagatatgacatgtttgataaaattcacgatttaattcgaaaaaatgatgtgcaaggatatgatgcatatcgttcagcattaagtaaggatcaaggattgaataaagaatatcaagattatatgcaaatgcttattgataatcgtgagaaatataatgttccgttagtgtcagatgactatttagcaaatcacgctccgaagcctgtttcagacatcgcatcggatattacggcggaagcaagactaaaagatgtgaaagtgacaaaacataaatcacaattctttaacacatttacattgcaaggaacatatacgggagatgctgcgaaaggagaatatgaggactggaaaacgataacgaaaacggtgaatgattcattgaaacgtttatcagcaaaagagtggacaggctataaaacattaacagcttatttcgttaactatcgagtaaatgcatctggtcaaatggaatatgatgttgtattccatggtatcaataccgaggggaatacagagaataaagcgccaattgcagttgtaaatggtccgtatactggaaatgtaaatgaatccatttctttcaagagtgatggttctaaagatgaagatggacaaattctttcttataaatgggaatttggagatggtcaaacaagtggtgaaaaaaatccatctcatgtttatacaaaagagggaacatatacagcgaaattaactgtaacagatgataaaggtgtgtctacttctgtaacaacaagtgtaacagttcaaaagaaagataccggaagtgtagaaacagaaccgaataattcatttaaaaccgcaaataaaattacgcttaatcaactattacgcgctagtttgagtgatgctgataacaatgatttctttgaaattaacgttgagactgcaaaaaatctacaaatcagtgtaacaaaggagaataatattggggtgaactgggtattatactctgcagctgatttaaataattatattacctatgcgcagccagaaggaaataaactagtaggtagttattatacgtatccaggaaaatattatttacatgtatataagtatagtggtgggtctggaaattatacagtagaggtaaaataa

SEQ ID NO: 94 - DNA, 2517 bp, Bacillus Sp.
ttgctctatcaaaatgatagtagaatgcaggcaattattgataaattgaaccagcaaggacaagcttatacgaaagatgattcaaaagggattgagactttagtagaggtgttacgatctggtttttatttaggattttatcatacagaattaagtaaactaaatgagcgaagctatcatgataaatgcttacctgcactaaaaacgattgcgaataacccgaattttaaactcggtacattagaacaaaatagagtcgtctcatcatatggaaaattaattggaaatgcttcaagtgatgtggaaacgatcacatcagctgcaaagatttttaaacaatataatgataatttttctacattggtagataatctttcagctggaaatgcgatttacgatattatgcaaggtgttgattacgatattcaatcgtatttgtacgatacgagaaaagcaccgaaagatacaatatggtatcaaaaaattgatagctatattaatgaattaagtcgttctgccttaattggaacggtgacagcgaaaaatggttggttaattaataatggtatttattatacaggtagacttggtacgttccatagtacagaaacgaaaggattacaagttgtaacagatgccatgaaaatctatccgtatttaggtgagcaatatttcgtagctgctgagcaaattgcgacgaattatggcgggaaagatgcgaatggtaaagtggttgatctagatcaaataagagaagatggtaagaaaaaatatttaccgaaaacgtatacgttcgatgatggagcaattgtgttaaaagctggagataaggtgactgaggaaaaagtaaaacgtctatattgggctgcaaaagaagtgaaggcacaattccatcgtacggttgaaagtgaccagccgttagaaaaaggcaatcctgatgatgtattaacgatggttatttataatagcccagctgaatatcaatttaaccgtcaattatacgggtatgaaacgaataacggcggtctttatatagaaggaacaggtacgttctttacttatgaacgtacgccagaagaaagcatttatagtttggaagaattgttccgacatgagttcacgcattatttacaaggtagatatgaagtgctaggactttggggacaagggaagatgtatgagaatgagagattatcttggtttgaagaagggaatgcggagttttttgcaggtgcaacgagaacagataatgttgtaccgagaaagagtattataggaggaatatcttcaaacccagcagaacgttatacagcagagagaacgttaaacgcaaaatatggaacgtgggatttctataattattccttcgctttacaatcgtacatgtacaataagagatatgatatgtttgacaaaattcatgatcttattagaaaaaatgatgtaacagcatatgatgcataccgctctgctttaagtaaagatgcgaatttaaataaagagtatcaagactatatgcaaatgttagtagataaccgtgagaaatataatgttccattagtatcagatgattatttagcaactcacgcaccgaaaccagtttcagatattgcagcagaaattacagcagaagcaaaattaagtaatgtatcagttaagaagaacaaatcacagttctttcatacatttacactacaaggaacatatacaggtacgactgcaaaaggagaatatgaagactggaaatcaattacacaaaacgtaaatgatacgttaaaacgtttaagtgcaaaagaatggacaggctataaaacagtaacagcgtacttcgtgaattatcgtgtgaatgcatcaggacaatttgagtatgatgttgtattccatggtattaatacagaagaaggtgctgtgaataaagtgccagttgcggttataaatgggccctatagtggaaatgtaaatgaagcaatttcgtttaaaagcgatggatcaaaagatgaagatgggaaaattacttcgtataaatgggagtttggtgatggagcagtaagtaatgagcaaaatccgactcacgtgtatacaaaagaaggaacatatacagcgaaattaacagtaacagatgacaaaggattaacgaatactgttacaacgaatgtaacggttcaaaagaaagaagataatagtgtagaaaaagagccgaataactcattccagacagcaaataaactgcagctaaatcaaattttacgtgctagtttaggaaacggtgatacgagtgattactttgaaatgaatgtggaaacggcgaaaaacctgcaaattaatgtaacgaaggaaaataatattggagtaaactgggttctttattcggaagcagatttaaataattatgttacgtatgcacagcaagaaggaaataagttagtaggaagttactacacgtatccagggaaatattatttacatgtgtatcagtatggcgggggaacagggaattatacggtagaagtgaaatag

SEQ ID NO: 95 - DNA, 2370 bp, Bacillus Sp.
atgttttgggaggagaaagaaatgaaattaaaaagaggtttactatttatttgtacttcaactatgcttgctataccaagtatggcaagtgctaaaaacaacgatgtcccattctataacggtcaaaatgattcgtttttaacttcacttaacttacagttgccaggaaaatattatagacctggaagtggatatgcagctaaagaatctttatacagggccgatgtgcactttcctgcagtatataacggctcttttaattgggataacccaagggagaatttagtacaagctgaagatacttcagagccgtatattcgaattgcaaatgaaggttatttaaatagtaaagtaccagcgggtgaccgtatggtgactgaagtagaaagggttaataattctgttatttctagtaaatattggggaaacccagaattcgttttagaaaatatggataaacatatgatacaaacttatgaaagttttagagaacttggacagttttattggattcgtgacattgcatatctttctggtggatacgctggtgctagtggtgtaggtaatataaataaatatagcctgtggtatgtacgtacaagtaaacctcaagtaaaagactttcaagctatgagtggaaaaaaagatatacctgttaaatttacatttaaaggttttgagtatgtaagtaaaaataaaggatacaatgaccgagatcccaatggaacaacagtaaacccttatcaaaaagctgctggagaacggaaccgagttaaatggatgttagatattacaaaagatggtgaaaccgtgtatcaccaagaaaattatctgcgttcaactccacaaaaagataaccaaaaaccaaatgaaggagatgcagggcaatttaaaaaagaagatataacctggcagccgcaattgtgtgggcaatatactgcgaaaattaaagtcctagatgctgttcagagggaatcaaatgagaaagctgttgatttcaccattgatggcaactgcggtactgaagtaacacctaacccagatccaggtgatgaagatgactttaaatataaaattgatttctctgctgaccgaattgaaggagaaacagcaagagaaggaaagaatatcaaaacaagagtagatgtatcacgtgataattttaaactagagcgtgatcaatatagagcaaaagtaaacaacaatattaataagtcacagcaagaaataaacagcactgaatctgatagagatagtgcacaatccagcttaagttattgtcgtcgcaatccaattcatgaagtagatgccgagggaaaggatcactattatgatagagactgctcttgggaagaaaataaattagatagtgcagcaagtaagctagataatgcaagacagaaactagaaaaagagaagaataaaattaaaaagttagatgtattagaagaaaaatatatgaatcctgaaacagtagttgtgttaaaacataacggacaacaagtagctttacaaaaggtaagattaactgagggagaaaagaaaaccctgaaccttgactggcaacataaaggtaaaggaacaattcaagcggaaattaaccctgctggtaatcgtatagacatcgaggaaactacgtacaaaaataatcctattaaaacagcaatctatgagccttcaaaagaaaaggcaatgtgtggtgtaacgagtgtaaaaggtgtagtagaaacagtaagtgaacgtgtatcaaaagaagatataactggggcaatgtattatgaaactttgacagggagtattggtaatttagctccttctaagctacattctggttatggattttcgtatgaagtaaacggtaagtacaaaaatgattggaatgcgaattaccctggtgtatttactgctgctaaggcacaatacccatttgcagacgaaggattaaagtctactcaagatttagagaagaaagaacttaaagatactacagcgaaattcctacctaaaaatatgtatttatctgaagcaacaggacatgtttttgatagtaaaagaccaactaagtctttatattgggatggacaagagaaaatcattgatggtggccaaaaatggtattcaccactgaagacaaaaaatggtgtatacacttttaatgtagaaacagctccagcaggtatcaatgaaatgagtttatgtttaactgagcaagtagagattaagggtgttgcgtatgatgatttcataaaaagaagagtatttcctgacgatccattccctggaggaagtggagttggttggaattgggttggtaaggaagatgtactttataaattaacagattggtattacatgagaaataggaaatga

SEQ ID NO: 96 - DNA, 2349 bp, Bacillus Sp.
atgaaattaaaaagaggtttactatttatttgtacttcaactatgcttgctataccaagtatggcaagtgctaaaaacaacgatgtcccattctataacggtcaaaatgattcgtttttaacttcacttaacttacagttgccaggaaaatattatagacctggaagtggatatgcagctaaagaatctttatacagggccgatgtgcactttcctgcagtatataacggctcttttaattgggataacccaagggagaatttagtacaagctgaagatacttcagagccgtatattcgaattgcaaatgaaggttatttaaatagtaaagtaccagcgggtgaccgtatggtgactgaagtagaaagggttaataattctgttatttctagtaaatattggggaaacccagaattcgttttagaaaatatggataaacatatgatacaaacttatgaaagttttagagaacttggacagttttattggattcgtgacattgcatatctttctggtggatacgctggtgctagtggtgtaggtaatataaataaatatagcctgtggtatgtacgtacaagtaaacctcaagtaaaagactttcaagctatgagtggaaaaaaagatatacctgttaaatttacatttaaaggttttgagtatgtaagtaaaaataaaggatacaatgaccgagatcccaatggaacaacagtaaacccttatcaaaaagctgctggagaacggaaccgagttaaatggatgttagatattacaaaagatggtgaaaccgtgtatcaccaagaaaattatctgcgttcaactccacaaaaagataaccaaaaaccaaatgaaggagatgcagggcaatttaaaaaagaagatataacctggcagccgcaattgtgtgggcaatatactgcgaaaattaaagtcctagatgctgttcagagggaatcaaatgagaaagctgttgatttcaccattgatggcaactgcggtactgaagtaacacctaacccagatccaggtgatgaagatgactttaaatataaaattgatttctctgctgaccgaattgaaggagaaacagcaagagaaggaaagaatatcaaaacaagagtagatgtatcacgtgataattttaaactagagcgtgatcaatatagagcaaaagtaaacaacaatattaataagtcacagcaagaaataaacagcactgaatctgatagagatagtgcacaatccagcttaagttattgtcgtcgcaatccaattcatgaagtagatgccgagggaaaggatcactattatgatagagactgctcttgggaagaaaataaactagatagtgcggcaagtaagctagataatgcaagacagaagttagaaaaagagaagaataaaattaaaaagttagatgtattagaagaaaaatatacgaatcctgaaacagtagttgtgttaaaacataacggacaacaagtagctttacaaaaggtaagattaactgagggagaaaagaaaaccctgaatcttgactggcaacataaaggtaaaggaacaattcaagcggaaattaaccctgctggtaaccgtatagacatcgaggaaactacatacaaaaataatcctattaaaacagcaatctatgagccttcaaaagaaaaggcaatgtgtggtgtaacgagtgtaaaaggtgtagtagaaacagtaagtgaacgtgtatcaaaagaagatataactggggaaatgtattatgaaactttgacagggagtattgataatttagctccttctaagctacattctggttatggattttcgtatgaagtaaacggaaaatataaaaatgactggaatgcaaattaccctggtgtatttgctgctgctaaggcacaatatccatttgcagacgaaggattaaaggctactcaagatttagagaagaaagaacttaaagataatacagcgaagttcctacctaaaaatatgtatttatctgaagcaacaggacatgtttttgatagtaaaagaccaactaagtctttatattgggatggacaagagaaaattattgatggtggccaaaaatggtattcaccattgaagacaaaagatggtgtatacacttttaatgtagaaacagctccagcaggtatcaatgaaatgagtttatgtttaactgagcaagtagagattaagggtgttgcgtacgatgatttcataaaaagaagagtatttcctgatgatccattccctggaggaagtggagtaggatggaactgggtagggaaagaagaactacttcataaattgactgattggtattacatgaagactgggaaataa

SEQ ID NO: 97 - DNA, 2370 bp, Bacillus Sp.
atgtttcaggaggagaaaaaaatgaaattaaaaagaggtttactatttatttgtacttcaactatgcttgctatacctagtatagcaagtgctaaaaacaacgatgttccattctataacggtcaaaatgattcttttttgacttcgcttaacttacagttgccaggaaagtattatagacctggaagtggatatgcagctaaagaatctttatatagggccgatgttcactttcctgctgtatataacggttcttttaattgggagaacccaagggagaatttagtacaagctgacgatacttcagagccatatattcgaattgcaaatgaaggttatttaaatggtaaagtaccagctggtgaccgtatggtgactgaagtagaaagggtaaataattctgttatttctagtaaatattggggaaacccagaattcgttttagacaatatagataaacatatgatacaaacttatgaaagttatagagaacttgggcagttttattggattagagacatagcctatctcgctggtggatacgcaggagctggtggtgtagaaggtgtaaataggtatagcttgtggtatgtacgtacaagtaaacctgaaataaaagattttaaagccaagagtggaaaaaaagatgtcccggttaaatttacatttagcggctttgagtatgtgagtaaaaataaaggatacaatgaccgagatcctaatggaacaacagttaatccctatcaaaaagctgctggagagcggaaccgagtgaaatggatgttagatattataaaagatggcgaaactgtgcatcatcaagaaaattatttgcgttcaaatccacaaaaagataatgaaagagccaatgaaggagatgctggaaagtttgtaaaagatgatgtgaaatggcagccgcaaatgtgcggtcgatatactgcaaaaattaaagtgcttgatgctgttcagagggaatcgaacgagaaaaacgttgatttcactatagatggtaactgtggtacagaagtaacacctaatccagatccaggtgatgaagatgattttaaatataaaattgatttctctgctgaccgaattgaaggagaaacagcaagagaaggaaagaatatcaaaacaagagtagatgtatcacgtgataattttaaaccagagcgtgatcaatatagaacaaaggtaaataacaatattaataagtcccagcaagaaataaacagtgctgaatctgatagagatagcgcgcagtccagtttgagttattgtcgccgtaatccaattcatgaagtagatgccgagggaaaggatcactattatgatagagactgctcttgggaagaaaataaactagatagtgcggcaagtaagctagataatgcaagacagaagttcgaaaaagagaagaataaacttaaaaagctagatgtattagaagaaaaatatacgaatcctgaaacagtagttgtgttaaaacataacggacaacaagtatcatcacaaaaggtaagattaaccgagggagaaaagaaaaccttaaacctggactggcaacataaagggaaaggaacaattcaggcagaaattaaccctgctggtaatcgcatagacatagaggaaactacgtataaaaataatcctattaaaacagcaatctatgagccttcaaaagaaaaggcaatgtgtggtgtaacgagtgtaaaaggtgtagtagaaacagtaagtgaacgtgtatcaaaagaagatatagttgggaaaatgtattatgaaactttgacagggagtattgataatttagctccttctaagctccattctggttatggattttcgtatgaagtaaacggaaaatataaaaatgaatggaatgcaaattaccctggtgtatttgctgctgctaaggcacaatatccatttgcagacgaaggattaaaggctactcaagatttagagaagatagaacttaaagataatacagcgaagttcctacctaaaaatatgtatttatctgaagcaacagggcatgtttttgatagtaaaagacctactaagtctttatattgggatggacaagagaaaatcattgatggtggacaaaaatggtattcaccactaaagacaaaagacggtgtatatacctttaatgtagaaacagctccagcaggtatcaatgaaatgagtttatgtttaactgggcaagtagagattaagggtgttgcgtacgatgatttcataaaaagaagagtatttcctgatgatccattccctggaggaagtggagtaggatggaactgggtcgggaaagaggaactacttcataaactgacggattggtattacatgaagactgggaaataa

SEQ ID NO: 98 - DNA, 2304 bp, Bacillus Sp.
ttggtatggccatcagtagcaagtgcaaataatggggatattccattttataatggaaatgaagacacgtctgtaaaatcacctgaattacaattgaatgggaagctacttagaccaggaagaggttataaatcaaaagagttcaattataaagcagatttacattttcctgctgtgtataatggttcctttaattggggaaattcgagggaaaaccttatccaaaatgaagaccattcagaaccctttgttcgcatttcaaatgatggttacattaatccttcagttacagtgggagaccgtatggtaaccgaaatggagagaattacaaacgatataattgcaagtaaatattggggtaaccctgaattcgttttaagaaatatagttccgcataggattaaaaatgaattttcagataaatcttatggagagttctattggattagggacattgcctatctttctggcggatacgcaggtgctggtggtgtaaatgatgtgaataggtatagcttgtggtatgtacgcacaagtaaacctcaaataaaagattttaaagctacgagtgggaaaaaagatatacccgtaaaatttacatttaacggttttgaatatgtaagtaaaaataaaggatacaatgaccgagatcctaatggaacaacagtaaatccttatcaaagagctgcaggtgaacgtaatcgagtcaagtggattcttgatattataaaagatggcgaaactgttcatcatcaagaaaattacttacgttcaactccacaaaaagataaccaaaaaccaaatgaaggagatgcagggcaatttaagtcagaagaactaaagtggcagccacaaatgtgtggccgatatactgcgaaaattaaagtccttgatgctgttcagagggaatcaaacgagaaaactgttgatttcaccatagatggtaactgtggtactgaagtaacacctaacccagatccaggagatgaagatgattttaagtataaaattgatttttctgctgatcgaattgaaggagaaacagcaagagaaggaaagaatatcaaaacaagagtagatgtatcacgtgataattttaaactagagcgtgatcaatatagagcaaaggtaaacaacaatattaataagtctcaacaagaagtaaatagctctgaatcggaaagagatagtgctcaatctagtctaagttattgtcgccgtaatccaattcatgaagtagatgccgagggaaaggatcactacattgatagagactgctcttgggaagaaaatagactagatagtgcggcaagtaagctagataatgcaagacagaagttagaaaaagagaagaataaaattaaaaagttagatgtattagaagaaaaatatacgaatcctgaaacagtagttgtgttaaaacataacggacaacaagtagctttacaaaaggtaagattaactgagggagaaaagaaaaccctgaaccttgactggcaacataaaggtaaaggaacaattcaagcggaaattaaccctgctggtaatcgtatagacatcgaggaaactacgtacaaaaataatcctattaaaacagcaatctatgagccttcaaaagaaaaggcaatgtgtggtgtaacgagtgtaaaaggtgtagtagaaacagtaagtgaacgtgtatcaaaagaagatataactggggaaatgtattatgaaactttgacagggagtattggtaatttagctccttctaagctacattctggttatggattttcgtatgaagtaaacggtaagtacaaaaatgattggaatgcgaattaccctggtgtatttactgctgctaaggcacaatacccatttgcagacgaaggattaaagtctactcaagatttagagaagaaagaacttaaagatactacagcgaaattcctacctaaaaatatgtatttatctgaagcaacaggacatgtttttgatagtaaaagaccaactaagtctttatattgggatggacaagagaaaatcattgatggtggccaaaaatggtattcaccactgaagacaaaagatggtgtatacacttttaatgtagaaacagctccagcaggtatcaatgaaatgagtttatgtttaactgagcaagtagagattaagggtgttgcgtatgatgatttcataaaaagaagagtatttcctgacgatccattccctggaggaagtggagttggttggaattgggttggtaaggaagatgtactttataaattaacagattggtattacatgagaaataggaaatga

SEQ ID NO: 99 - DNA, 2355 bp, Bacillus Sp.
atgaaattaaaaagaagtttgttgttactgtgtacctcaacagcattaatgattccaagtatagcgagtgcgaaaaatgcggatgttcctttttataacggaacaaatgatacctctcttacttctagaaaattacaaatgacaggtaagttttatcgttttgggagtaattatgcaccacctggtatagatttagcgtacaaaggagatcttcattaccccgctgtttacaatggctcttttagttttgaaaacccacaagcaaacttagtacaaagagaagacctaagtgagccttatgtgaggatttcgaatgaaggttattggaatagtgctatcgctgttggggatcgtatgataacggaaaaagagaggattactgaatctatcatttctgataaatattggggtaattctcaatttgtcctaaataatatagattcgcacacagtatctaatggtaattcaccaaaatcatatggtctgttttattggattcgtgatatagcctatctttctggtggatatgcaggtgctggtggcgtaaatggaataaataaatatagtctatggtatgtacgaacaagtaaacctaaaataaaagattttaaagtctctagtggtaagaaggatacacctgttaagtttacatttaacggtttcgagtatgtaagtaaagagaaaggatatacagaacgtggtcccaaactcgatataggtaacccttattcatcgatagcaggtgaacgaaatcgtgtgcaatggctactagatattactaaaagtggtgaaacagtgcatcatcaagaaaattacttacgttcaacgccacaaaaagataatcaaaaaccaaatgaaggtgatgcaggacgatttacgaaagaagatataaggtggcagcctcagatgtgtggtcgttatactgcaaaattaaaaattattgatggggttcaaagggggtcaaatgagaaaacagttgattttattgtagatggaaactgtggtacagaagtaacacctaatccagatccaggtgatgaagatgattttaaatataaaattgatttctctgctgaccgaattgaaggagaaacagcaagagaaggaaagaatatcaaaacaagagtagatgtatcacgtgataattttaaactagagcgtgatcaatatagagcaaaagtaaacaacaatattaataagtctcaacaagaaataaacagcactgaatctgatagagatagtgcacaatccagcttaagttattgtcgtcgtaatccaattcatgaagtagatgccgagggaaaggaccactattatgatagagactgctcttgggaagaaaataaactagatagtgcggcaagtaggctagataatgcaaggcagaaactagaaaaagagaagaataaaattaaaaagttagatgtattagaagaaaaatatatgaatcctgaaacagtagttgtgttaaaacataacggacaacaagtagctttacaaaaggtaagattaactgagggagaaaagaaaaccctgaaccttgactggcaacataaaggtaaaggaacaattcaagcggaaattaaccctgctggtaatcgtatagacattgaggaaactacgtacaaaaataatcctattaaaacagcaatctatgagccttcaaaagaaaaggcaatgtgtggtgtaacgagtgtaaaaggtgtagtagaaacagtaagtgaacgtgtatcaaaagaagatataactggggaaatgtattatgaaattttgacagggagtattggtaatttagctccttctaagctacattctggttatggattttcgtatgaagtaaacggtaagtacaaaaatgattggaatgcgaattaccctggtgtatttactgctgctaaggcacaatacccatttgcagacgaaggattaaagtctactcaagatttagagaagaaagaacttaaagatactacagcaaaattcctacctaaaaatatgtatttatctgaagcaacaggacatgtttttgatagtaaaagaccaactaagtctttatattgggatggacaagagaaaatcattgatggtggccaaaaatggtattcaccactgaagacaaaagatggtgtatacacttttaatgtagaaacagctccagcaggtatcaatgaaatgagtttatgtttaactgagcaagtagagattaagggtgctgcgtatgatgatttcataaaaagaagagtatttcctgacgatccattccctggaggaagtggagttggttggaattgggttggtaaggaagacgtactttataaattaacagattggtattacatgagaaataggaaatga

SEQ ID NO: 100 - DNA, 2304 bp, Bacillus Sp.
ttgttattaccgtcagtagcaagtgcaggaaatagtgatgtaccattttataatggaaatgaaactacgattttagcatcagacgaattacaattaaagggaaaactacttaggtctggaagtagatataagccaaaagagttcgaatataaagctgatatacattttcctgctgtttataatggttcttttaattgggggaatccaagggaaaaccttatccataatgaagaccagtcagagccttatgtgcgtatatcaaatgacggctacattaacccttcagttgtagtaggagatagaatggtaactgaagtggagagaattacaaatagcataattacggataaatattggggtaactctcagtttgttttaaaatatttaattccacataagattacaaatcaagattcctttgaatcttatggacatttctattggattagggatattgcctatctttctggaggatacgcaggggctggtagtgtaaatggtgtaaataggtataacttgtggtatgtacgcacaagtaaacctgaaataaaagattttaaggctacgagtggaaaaaaagatgtacctgtgaaatttacatttaacggattcgaatatgtaagtaaaaataaaggatataatgatcgggatccaaatggcacaacagtaaatccatatcaagcagctgcaggtgaacggaaccgagttaaatggatgttagatattacaaaagatggcgaaaccgtgtatcatcaagaaaattatctgcgttcaactccgcaaaaagataatcaaaaaccaaatgaaggtgatgcagggcaatttaagtcagaagaactaaagtggcagccacaaatgtgtggccgatatactgcgaaaattaaagtcattgatgctgttcaaagggaatcaaatgagaaaactgttgatttcaccataaatggtaactgtggtacagaagtaacacctaatccagatccaggtgatgacgatgattttaaatataaaatcgatttctctgctgaccgaattgaaggagaaacagcaagagaaggaaagaatataaaaacaagaatagatgtatcacgtgataattttaaaccggaacgtgaccaatatagagcaaaggtaaacaacaatattaataagtctcaacaagaagtaaatagctctgaatcggagagagatagcgctcaatctagtctaagttattgtcgccgtaatccaattcatgaagtagatgccgagggaaaggatcactattatgatagagactgctcttgggaagaaaataaactagatagtgcggcaagtaagctagataatgcaagacagaagttagaaaaagagaagaataaaattaaaaagttagatgtattagaagaaaaatatacgaatcctgaaacagtagttgtgttaaaacataacggacaacaagtagctttacaaaaggtaagattaactgagggagaaaagaaaaccctgaatcttgactggcaacataaaggtaaaggaacaattcaagcggaaattaaccctgctggtaaccgtatagacatcgaggaaactacatacaaaaataatcctattaaaacagcaatctatgagccttcaaaagaaaaggcaatgtgtggtgtaacgagtgtaaaaggtgtagtagaaacagtaagtgaacgtgtatcaaaagaagatataactggggaaatgtattatgaaactttgacagggagtattgataatttagctccttctaagctacattctggttatggattttcgtatgaagtaaacggaaaatataaaaatgactggaatgcaaattaccctggtgtatttgctgctgctaaggcacaatatccatttgcagacgaaggattaaaggctactcaagatttagagaagaaagaacttaaagataatacagcgaagttcctacctaaaaatatgtatttatctgaagcaacaggacatgtttttgatagtaaaagaccaactaagtctttatattgggatggacaagagaaaattattgatggtggccaaaaatggtattcaccattgaagacaaaagatggtgtatacacttttaatgtagaaacagctccagcaggtatcaatgaaatgagtttatgtttaactgagcaagtagagattaagggtgttgcgtacgatgatttcataaaaagaagagtatttcctgatgatccattccctggaggaagtggagtaggatggaactgggtagggaaagaagaactacttcataaattgactgattggtattacatgaagactgggaaataa

SEQ ID NO: 101 - DNA, 2352 bp, Bacillus Sp.
atgaaattgaaaagaaatttactattaactttatgtacttcaacagtgttaatgctaccgagtatagctaatgccaaaaatattgatatacctttttataatggagaagataatacatttcttacttcaagtgatttacaaatgccgggtaaattttttcggccaggaggtggatttgagccagtaaaaacattatataaagcagatattcattatccggctgtttataatggtgcctttaattgggggaatccaaaagaaaatttggttaagaacgaagataatacagaaccatttgtgagaattgccaatgaaggttattttaatgataaagtgcccgtaggagatcgaatggtaacagaagtagaacgtgtaaatgcatctgttattaaagataagtattggggtaatccggattttgttttaaaatcaatgctgccacatgaaattactggttttagagattttaaaagctttggaatgttttattggattcgtgatattgcttatctttctggtggttatgcgggagcgggtgctgtagagggagttaataagtacaatttatggtatgtacgcacaaataagccggaattaaaagatttcaaagcttcaagtagtacaaaggatgtagcagttaaatttacatttaatggttttgaatatgtaagtaaaaataaaggatataatgatcgggatccaaatggcacaacagtaaatccttatcaagcagctgcaggtgaacggaaccgagttaaatggatgttagatattacaaaagatggtgaaactgtgcatcatcaagaaaattacttgcgttcaactccacaaaaagataatgaaaagtctaatgaaggagatgctggaaagtttgtaaaagatgatgtgaaatggcagccgcaaatgtgtgggcgatatactgcaaaaattaaagtgcttgatgctgttcaaagggaatcgaacgagaaaaacgttgatttcaccatagatggtaactgtggcactgaagtaacacctaacccagatccaggtgatgaagatgactttaaatataaaattgacttttctagtgacagaattgaaggagaaacagcaagagaagggaaaaatatcaagacgagggtagatgtatcacgtgataatttcaagcctgaacgtgaccaatatagagtaaaggtaaacaacaacattaataagtctcaacaagaaataaatagctctgaatcggaaagagatagcgctcaatctagtctaagttattgtcgccgtaatccaattcatgaagtagatgccgagggaaaggatcactattatgatagagactgctcttgggaagaaaataaactagatagtgcagcaagtaagctagataatgcaagacaaaagttcgaaaaagagaagaataaacttaaaaaattagatgtattagaagaaaaatatacgaatcctgaaaccgtagttgtgttaaaacataacggacaacaagtatcaacacaaaaggtaagattaactgagggagaaaagaaaaccttaaaccttgactggcaacataaagggaaaggaacaattcaggcggaaattaaccctgctggtaatcgcatagacatagaggaaactacgtataaaaataatcctattaaaacagctatctatgcaccatcacatgaaaaagggatgtgcggtgtaacaagtgtaaaaggtgtagtagaaacagtaagtgaacgtgtgacaaaagaggacacagtgggagaaatgttctatgaaacattaagtggaagtatagataatttggcaccatctaagcttcattctggctatgggttttcgtatgaagtaaacggaaagtataaaaatgattggaatgaaaattaccctggtgtatttgccgctgctaaggcacaatacccatttgcagacgaaggattaaagtctacccaagatttagataagaaggaactaaaagataatacagcgaagttcctacctaaaaatatgtatatgtctgaatcaactggccatgtgtttgatagtaaaagaccgaccaagtctttatattgggatggacaagagaaaatcattgatggtggccaaaaatggtattcaccactaaagacaaaagacggtgtatatacctttaatgtagaaacagctccagcaggtatcaatgaaatgagtttatgtttaactgggcaagtagagattaagggtgttgcgtacgatgatttcataaaaagaagagtatttccggatgatccattccctggaggaagtggagtaggatggaattgggtagggaatgaggaactacttcataaactaactgattggtattacatgaagactgggaaataa

SEQ ID NO: 102 - DNA, 2355 bp, Bacillus Sp.
atgaaattaaaaagaagtttgttgttactgtgtacctcaacagcattaatgattcctagtatagcgagtgcgaaaaatgcggatgttcctttttataacggaacaaatgatacctctcttacttctagaaaattacaaatgacaggtaagttttatcgttttgggagtaattatgcaccacctggtatagatttagcgtacaaaggagatcttcattacccggctgtttacaatggctcttttagttttgaaaacccacaagcaaacttagtacaaagagaagacctaagtgagccttatgtgcggatttcgaatgaaggttattggaatagtgctatcgttgttggggatcgtatgataacggaaaaagagaggattactgaatctatcatttctgataaatattggggtaattctcaatttgtcctaaataatatagattcgcacacagtatctaatggtaattcaccaaaatcatatggtctgttttattggattcgtgatatagcctatctttctggtggatatgcaggtgctggtggcgtaaatggaataaataaatatagtctatggtatgtacgaactagtaaacctgaaataaaagattttaaagtctctagtggtaagaaggatacacctgttaagtttacatttaacggtttcgagtatgtaagtaaagagaaaggatatacagaacgtggtccaaaactagatataggtaacccttattcatcaatagcaggtgaacgaaatcgtgtgcaatggctactatatattactaaaagtggtgaaacagtgcatcatcaagaaaattacttacgttcaacgccacaaaaagataatcaaaaaccaaatgaaggtgatgcaggaaaatttacgaaagaagatataagttggcaacctcagatgtgtggtcgttatactgcaaaattaaaaattgttgatggggttcaaaggggttcaaatgagaaaacagttgattttattgtagatggaaactgtggtacagaagtaacacctaatccggatccaggtgatgaagatgattttaaatataaaattgatttctctgctgaccgaattgaaggagaaacagcaagagaaggaaagaatattaaaacaagagtagatgtatcacgtgacaattttaaaccagaacgtgaccaatatagagaaaaggtaaacaacaatattaataactctcaacaagaagtaaatagctctgaatcggaaagagatagtgctcaatctagtctaagttattgtcgccgcaatccaattcatgaagtagatgccgagggaaaggatcactacatttatagagactgctcttgggaagaaaatagactagatagtgcggtaagtaagctagataatgcaagacagaagttagaaaaagagaagaataaaattaaaaagttagatgtattagaagaaaaatatacaaatcctgaaacagtagttgtgttaaaacataacggacaacaagtagctttacaaaaggtaagattaactgagggagaaaagaaaaccctgaatcttgactggcaacataaaggtaaaggaacaattcaagcggaaattaaccctgctggtaaccgtatagacatcgaggaaactacatacaaaaataatcctattaaaacagcaatctatgagccttcaaaagaaaaggcaatgtgtggtgtaacgagtgtaaaaggtgtagtagaaacagtaagtgaacgtgtatcaaaagaagatataactggggaaatgtattatgaaactttgacagggagtattgataatttagctccttctaagctacattctggttatggattttcgtatgaagtaaacggaaaatataaaaatgactggaatgcaaattaccctggtgtatttgctgctgctaaggcacaatatccatttgcagacgaaggattaaaggctactcaagatttagagaagaaagaacttaaagataatacagcgaagttcctacctaaaaatatgtatttatctgaagcaacaggacatgtttttgatagtaaaagaccaactaagtctttatattgggatggacaagagaaaattattgatggtggccaaaaatggtattcaccattgaagacaaaagatggtgtatacacttttaatgtagaaacagctccagcaggtatcaatgaaatgagtttatgtttaactgagcaagtagagattaagggtgttgcgtacgatgatttcataaaaagaagagtatttcctgatgatccattccctggaggaagtggagtaggatggaactgggtagggaaagaagaactacttcataaattgactgattggtattacatgaagactgggaaataa

SEQ ID NO: 103 - DNA, 2346 bp, Bacillus Sp.
atgaaattaaaaagaaatttattactaacgttatgtacttcaacaatgttaatggttccaactatagcaagtgcgaaaaatgctgatattcctttttacaatggaaatgacgatacatttatttcttctcaattacaaatgccaggtaaatattttcgccctggaagtgggtttgaccccgtaaaaacattatataaagcagatatacattatccagcggtttataatggttcttttaattgggataatcctagacaaaatctagtgcaaagtgaagatagttcagagccatttgtaagaattgcaaatgaagggtattttaataattcagttccggtcggtgatcgtatggtaacagaaatagaacgtgtaaatgcatctgttattaaagataaatattggggaaatacagattttgttttaaaaaatataattccaaataaaatttctggggctgtagatttaaagagttttggagaattttattggattcgagatatggcatatctttctggtggatatgcgggtgctggggctgtagaaggggttaataaatatagtttatggtatgtgcgtacaagtaaacctgaaataaaagattttaaagccaagagtggaaaaaaagatgtccctgttaaatttacatttaacggttttgagtatgtaagtaaaaataaaggatacaatgaccgagatcctaatggaacaacagtaaacccttatcaaaaagctgctggagaacggaaccgagttaaatggatgttagatattacaaaagatggcgaaaccgtgtatcatcaggaaaattacttacgttcaactccgcaaaaagataatcaaaaacccaatgaaggtgatgcagggcaatttaagtcagaagaactaaagtggcagccacaaatgtgtggtcgatatactgcgaaaattaaagttcttgatgctgttcagagggaatcaaacgagaaaactgttgatttcactatagatggtaactgtggtactgaagtaacacctcacccagatccaggagatgaagatgattttaaatataaaattgatttttctgctgatcgaattgaaggagaaacagcaagagaaggaaaagatatcaaaacaagagtagatgtatcacgtgataattttaaaccagagcgtgatcaatatagagcaaaggtaaataacaatattaataagtcacagcaagaaataaacagtgctgaatctgatagagatagcgcgcagtccagtttgagttattgtcgccgtaatccaattcatgaagtagatgctgagggaaaggatcattattatgatagagactgctcttgggaagaaaataaactagataatgcggcaagtaagctagataatgcaagacagaagttagaaaaagagaagaataaaattaaaaagttagatgtattagaagaaaaatatacgaatcctgaaacagtagttgtgttaaaacataacggacaacaagtagctttacaaaaggtaagattaactgagggagaaaagaaaacactaaacttggattggcaacataaagggaagggaaccattcaggcggaaattaaccctgctggtaatcgtctagatatagaagaaaccacatacaaaaataatcctattaaaacagcaatttatgaaccttcaagagaaaaggcaatgtgtggagtaacgagtgtaaaaggtgtagtagaaacagtaagcgaacgtgtgtcggaagaagatacagcgggagaaatgttctatgaaacattaagtggaagtattgataatctatcaccttctaaacttcatagtggctatggtttttcgtatcaagtaaatggaacatataaaaatcagtggaatgaaaattatcctggtgtttttacagcagcaacggcacaatatccatttgcagatgaagggctaaaaacaacacaagatttagaggcaatttctaatactggattagcatcaagattccaacctaaaaatatgtatatgtctgaaataacaggacatgttttcgatagcaaaagaccaactaagtctctatattgggatggtcaagaaaaaattattgatggccaacgtaaatggtatgctccattaaaaacgaaagatgggaaatatgcattcaatgttgaaacaaaaccagcgggtgtaaatgaaatgagcttgtgcctgacaagtgaggtagaaattaaaggagtcgcatacgatgactttaaaaagagaagggtgcttgcagatcttccatttcctgtgcaaacaccaggatggaactgggttggaaaggaacatattattactgatttatcaaactggtactatatgaagaatagaaaatag

SEQ ID NO: 104 - DNA, 2216 bp, Bacillus Sp.
gtgaagttacgaaaaagagtattgttaacttgcacatcattaatgttagcattgccatcggttgcgagtgcggcgaataataacataccatttttcgatggtagcgaaaattcgttattaaaatcagacgaattacaattaaaaggtaaattgcttagaccaggaagtggttacaaatcaaaagagttcgattataaagctgatttacattttcctgctgtttacaatggttcattcaattggggaaatccatgggaaaatctagtccaaaatgaagatacatcagatccttatgttcgaatctcaaatgatggttacattaacagtgcagttgttgttggggatcgaatggtaacagaagttgaacaagttacaaaaactgttgttaaagataaatattggggtcagccagattttgttttaacaaatatggcaaaacataaaatcataaaattcaaaggatcaaatgattctttaggaagtttctactggattagggacattgcctatctttctggtggatacgcaggtgctggtggtgtaaatggtgtgaataggtatagtttgtggtatgtacgcacaagtaaacctcaaataaaagattttaaagctacgagtgggaaaaaagatatacccgtaaaatttacatttaacggttttgaatatgtaagtaaaaataaaggatacaatgaccgagatcccaatggaacaacaataaacccttatcaaaaagctgctggagaacggaaccgagttaaatggatgctagatattacaaaagatggcgaaaccgtgtatcatcaagaaaattatctacgttcaactccgcaaaaagataatcaaaaaccaaatgaaggtgatgcaggacaatttaagtcagaagaactaaagtggcagccgcaaatgtgtggtcgatatactgcgaaaattaaagtccttgatgctgttcaaagggaatcgaacgagaaaaaagttgattttaacatagatggtaactgtggaactgaagtaacacctaacccagatccaggtgatgaagatgattttaaatataaaattgatttctctgctgaccgaattgaaggagaaacagcaagagaaggaaagaatatcaaaacaagagtagatgtatcacgtgataattttaaatcagatcgtgaccaatatagagcaaaggtaaacaacaatattaataagtctcaacaagaagtaaatagctctgaatcggagagagatagcgctcaatctagtctaagttattgtcgccgtaatccaattcatgaattagatgccgagggaaaggatcactattatgatagagactgctcttgggaagaaaataaactagatagtgcggcaagtaagctagataatgcaaaacagaagttcgaaaaagagaagaataaacttaaaaagctagatgtattagaagaaaaatatacgaatcctgaaacagtagttgtgttaaaatataacggacaacaagtatcatcacaaaaggtaagattaaccgagggagaaaagaaaaccttaaacctggactggcaacataaagggaaaggaacaattcaggcagaaattaaccctgctggtaatcgcatagacatagaggaaactacgtataaaaataatcctattaaaacagcaatctatgagccttcaaaagaaaaggcaatgtgtggtgtaacgagtgtaaaaggtgtagtagaaacagtaagtgaacgtgtatcaaaagaagatatagttgggaaaatgtattatgaaactttgacagggagtattgataatttagctccttctaagctacattctggttatggattttcatatgaagtaaacggtaagtacaaaaatgattggaatgcaaattaccctggtatatttactgctgctaaggcacaatacccatttgcagacgaaggattaaagtctactcaagatttagagaagaacgaacttaaagataatacagcgaaattcttacctaaaaatatgtatttatctgaatcaacgggacatgtttttgatagtaaaagaccaactaagtctttatattgggatggacaagagaaaatcattgatggtggccaaaaatggtattcgccactgaagacaaaagatggtgtatacacttttaatgtagaaacagctccagcaggtatcaatgaaatgagtttatgtttaactgagcaagtagagattaagggtgttgcgta

SEQ ID NO: 105 - DNA, 2346 bp, Bacillus Sp.
atgaaactgaaaaaaaatatattattaacctgtacttctttaattttgttattaccgtcagtagcaagtgcgggaaatagtgatgtaccattttatgatggaaatgaaactacgattttagcatcagacgaattacaattgaagggaaaactacttaggcctggaagtagttataagccaaaagagttcgcatataaagctgatatacattttcctgctgtttataatggttcttttaattgggggaatccaagggaaaaccttatccaaaatgaagaccagtcagagccttatgtgcgtatatcaaatgacggctacattaatccttcagttgtagtgggagatagaatggtaactgaagtggagagaattacaaatagcataattacagagaaatattggggtaactctcagtttgttttaaaatatttaattccacataagattacaaatcaagattcctttgaatcttatggacatttctattggattagggacattgcctatctttctggcggatatgcaggggctggtggtgtaaatgatgtgaataggtatagcttgtggtatgtacgcacaagtaaacctcaaataaaggattttaaagctacgagtgggaaaaaagatatacccttaaaatttacatttaacggttttgaatatgtaagtaaaaataaaggatacaatgaccgagatcctaatggaacaacaataaatccttatcaaaaagctgctggagaacggaaccgagttaaatggatgttagatattacaaaagatggtgaaactgtatatcatcaagaaaattacctgcgttcaactccgcaaaaagataatcaaaaaccaaatgaaggtgatgcagggcaatttaagtcagaagaattaaagtggcagccacaaatgtgtggccgatatactgcgaaaattaaagtccttgatgctgttcagagggaatcaaacgagaaaactgttgatttcactatagatgataactgtggtactgaagtaatacctaacccagatccaggcgatgaagatgactttaaatataaaattgacttttctagtgatagaatcgaaggagaaacagcaagagaaggaaagaatataaaaacaagaatagatgtatcacgtgataattttaaaccagaacgtgaccaatatagagaaaaggtaaataacaatattaataagtcccagcaagaaggaaatagttctgaatctgatagagatagtgcgcagtctagtcttagttattgccgtcgtaatccaattcatgaggtagatgcagaagggaaccatcactattacgatagagactgttcttgggaagaaaataaactagatagtgcagcaagtagactagataatgcaagaaagaaactagaaaaggagaagaataaaattaaaaagttagatgtattagaagaaaaatacacgaatcctgaaacagtagttgtgttaaaacataacggacaacaagtggcatcacaaaaggtaagattaacagagggagaaaagaaaaccttgaaccttggctggcaacataaggggaaaggaacaattcaggcagaaattaaccctactggtgatcgtctagatatagcagaaaccacatacaaaaataatcctattaaaacagctatctatgcaccatctcatgaaaaagggatgtgcggagtaacgagtgtaaaaggtgtggtagaaacagtaagtgaacgtgtttcaaaagaggacacagtgggagaaatgttctatgaaacattaagtggaagtattgataatttagcaccatctaagctccatgctgggtatggtttttcttatgaattaaacggaaaatacaaaaatgattggaatgccaattatccaggtgtatttacaaaagcaatggcgcaatacccatttgcagatgaaggactaaaaacaacaaatgatttagagagtgtttctaataatggcttaacatcaaaatttctacctgaaaatatgtatttgtctgaagtaacaggacatgtcttcgatagtaaaagaacaactaagtctttatattgggatgggaaagaaaaaattattgatggccagcgcaaatggtatgcgccattaaaaacgaaagatggaaaatattcgttcaatgttgaaacaaacccagcgggcgtgaatgaaatgagtttgtgcctgacaaatgaagtggaaattaaaggtgttgcgtacgatgattttaaaaagagaagggtgcttgctgatcttccatttcctgtacaaacaccaggttggaactgggttggaaaggaacatattattactgatttgtcaaactggtattatatgaagaatagaaattag

SEQ ID NO: 106 - DNA, 4284 bp, Bacillus Sp.
atggttgtaaagagaggaggaatacgattgtggtttagaaggtcatttagtttactatttgttgttatgcttctgtttggaagcttggccgactttgtatcaattggacatgcagaaagtacatcggaccagaaacaggctcaagagaaaaaaacggacgatgtgactgtgctgcaagaaaaatctgatctgaagagtacgggaactaatccaagcgaggtagttgtagcaaatggtaaaaaaggtagtgagttgtttgattttgaagcctttattaagccttcagacattgtagatggaacagcaccttttgattcgaatgatgaagcaggtaatgattctagccctaataatggcattgtaaggacgtttgatacagtaacgtacccattgaaagtgacgattaatcctaagaagaatgaaacgttaaaaaatattaagatgaaaatcactggtacattagaaaatggaattacaaacaagcgtgttaatgcaaaatttgctgttggtggtaaagaggatttggaaaagggtattgtttcttttgatatggaatacacgttaaaggaaacaggtaactccttaatgattcctgttacggtggaagtacaaggggcggagcatggattgaaattaaagcctaacattaaaatccaggttataagtgtagatgggaaagatattgcaaatgaaaatgtatcgcaatcatttgatggtattagtcccgttactacttcaggaaaggttaatgtaaaggctcgctttactgcttcttatggtggaatgcctagattggattataaggtttatgatcccaatgcaaaagaggatgatcgtacaatcatatatccagttgctttagatttatttgtaaataatttaccaaaccgaactgatttacgaggagctacattccctgctggaaagattaattatcactttaatttttcaggaaaagtcgattgggattataaatcgttaggtgcagaaacattgaattttgagggtcgggataaaccgataaagatctttaactatcaggctattgataaaatagtagataaagtgccacaagaaggtacggaaagttttgaaattggtatgaagggctataaagatcctcgtactgagacagcaaacagtcctaaatcatatattccaaaagatatatggaatgctagtgatattgataaatacacgattgacagtgtatgggatagtggaacagtacgtttgaataaaccagaaattacaaaggatcgtgtaggttatacgggtagtatagaagactatgtaattggttcaactttcccaacgatgatgtcaaggccaggttattcagtaattcctaccttcggaaagaatgaaaaagcattttcaagcacacgtttcttaatacattcaacaaatgaatattatcctgtactgggtaaaaataataaggataatctaccgaataatgttttttattatttagaatttgttattgattcttatgaggatggcaagggtaatacaattccttataacactgttggaagatacacgcttaccgaaaggaataaccctaaaggtgcatactccatacaaactacattccatacaacagatcataaggagttaggtacaccaaatgttggctatagcgctgtatctaaaggagatccaacagttatagtaggacaaaatgtaaaagtcgttagtcatttgaatgttcgtgctgttacagaaggtggtacaacgatgatttataagtggaatacagattcgttttatctatctaaaaatagtgcggaaacagctaggaagaacatgttaaacgaggggtatcccaacacttctgcgggaagggttacaaatagtgataaacaaaaaatctattttggaatatctaaaaaaggagataattcttttgaaacactaacccaaaacaaagatgaggattatgattggtatagcacatatgatgaagcaaagaaacaaggtgaagtagctgctatcaaaaatgatattaatgcatctatgggggatggtgaggttgtagcatggaatattccattagaggtaaaaacaaagaaaataggtagtgttaatgaaaaaggaacgccaaacataacggttacggattcaatagtgtatccttcagctgatagaaaagtgggttatcgagtacgtggtgaagggaaatataataactttactgagtatgatgaaaagggaaatataacaaaactgcaatctcctgtaggaagtactgtgaattttgaaacgctaggcattatgaatggtgagacgagtagtgatgtgaaaacaaataaaaatacttactacagttcagataatgttagtgtaaccgttgataatttagtaaagttacctgatgcaatggattataattcattagatgaaaaagtagaaatgagagtgaaaataccaaaaggtcttgattatgtggttggttctgctaaatatggtgatcagtatatcgaaccaaaaattgagcaacaaaatgatggaagtaatcatttgatttggcatgacacattgactcgtggtaataaaacgctcaaaaaaatcaactttgagacaagaattaatcctgtactacttccgcaaggaaatcaggtaggtttggaaattacgaatgttcttagtagtgcgatggacacaagggcagaaaaatttaggacaagttctaagaatatttcagttgtgaaaattggtatggttggtgttagtgaaacaattgagaaagtgacagggaaaaagaacagtgactatgtggtcggtgttcaaccgtatacgacaatcaaagatgagtcacatattaaggcacttacatatgttccaagaaataaggatcataatggatctgcttttaatggtgttactttcttgagacaaatagcactagaaaatgctaataataagaacgttgaaatatggcttaataacagctttgttgaatcaaataatccaaacaaaattgatttaaagtcaaatggttggtataggtatacaggagagcaggatctatcaaaagtggtctctattttgctgtatataaatgattcattaagtagcagcgatattgtaaaaatgaatcttgtttacggcacacataaaaatgaatttggagatttttacgtaagtaaaacagtggtaaatacctctgttgattacaaattatctcctgtttctaaccaggtgaaatatacaattgtagcagatgcaaatttaggtcttagaaaaataagaatcgatactgcacctgctgatattggtttgccagtaattgtacgtttagacaaggacatcatttatgaggactctaataagagtaatgttgctgttaacttatatgataagtctgataataagttggtagacagtaaagtatatacaattcaggaattaccggaggaaataaaattcaaggtagatcctaaatttttaaagaaaaataataagagaaactacgaggttagatttgaaaaagtcaataaagaatctatttttatcgtagatgggaaaggaaaagtagatacggatggttatacttcttctgaagaaactgtaaaggcaaatacaaaagcatctactgagttaaaatataaaggcgttataatgacggagcgtgaagtcggaaaagagatggaagtcttttatgaaacacttacaattccgttaaaacagctacctaaacaaaaaactggctatggttttgagttgaaaccattagttagttataacaatgaattagcggtttcttatgatgttaagacaaatgctttagtagataagagattaattgattctcatttgaattatgagaaaaaaggtgatcaatttgttgttcctttagaagaagctgagaaaacaggcagcacggacaaaaagaacactgattatctttttgaattgccacatattaatgtggaacaaaaaacgggtaatttatttacagaccaacaagtaaaagaccatgatccacgtattaagaatgcaataaaggatgggaagcgaaagttatatgttcctatttgggcagatctgggagaatacaacgttttaatagtatcgggaatccctataggcgctaataaagttaactttgaggtaacacaaccattaaatttatatgcatatatgtacgggacaattggctcgaaaaccctggaagatgatgaattactgttagagcctgttgatccaaaaaatcctttctcaaatggcaaaccgcctggttggtcagatgtagatgttgcttggttaaagcaatag

SEQ ID NO: 107 - DNA, 4257 bp, Bacillus Sp.
ttgtggtttagaaggtcatttagtttactatttgttgttatgcttctgtttggaagcttggctgactttgtatcaattggacatgcagaaagtacatcggaccagaaacaggctcaagagaaaaaaacggacgatgtgactgtgctgcaagaaaaatcggacctgaagagtacaggaattaatccaaacgaggtagttgtggcaaatggtaaaaaaggtagtgagttgtttgattttgaagcctttattaagccttcagacattgtagatggaacagcaccttttgattcgaatgatgaagcaggtaatgattctagccctaataatggcattgtaaggacgtttgatacagtaacatatccacttaaggtgacgattaatcctaagaagaatgaaacgctaaaaattattaagatgaaaatcaccggtacattagaaaatggaattacaaacaagcgtgttaatgcaaaatttgctgttggcggaaaagaggatttagaaaagggtatcgtatcttttgatatggaatacacgttaaaagaaacaggtaactccttaatgatccctgttacagtggaagtacaaggggcggagcatggactgaaattaaaacctaacataaaaatccaggttataagtgtagatgggaaagatattacaaatgaaaatgtatcgcaatcatttgatggtattagtcccgttactacttcagggaaggttaatgtaaaggctcgctttactgcttcttatggtggaatgcctagattggattataaggtttatgatcccaatgcaaaagagggtgatcgtacaatcatatatccagtcgctctagatttatttgtaaataatttaccaaaccgaactgatttacgaggggctacattccctgctggaaagattaattatcactttaatttttcaggaaaagtcgattgggattataaatcgttaggtgcagaaacattgaattttgagggtcgggataaaccgataaagatctttaactatcaggctattgataaaatagtagataaagtgccacaagaaggtacggaaagttttgaaattggtatgaagggctataaagatcctcgtactgagacagcaaacagtcctaaatcatatattccaaaagataaatggaatgctagtgatattgataaatacacgattgacagtgtatgggatagtggaaaagtacgtttgaataaaccagaaattacaaaggatcgtgtaagttatacggggagtatagaagactatgtagttggttcaacctttccaacgatgatgtcaaggccaggttattcagtaattcctaccttcggaaagaatgaaaaagcattttcaagcacacgtttcttaatacattcaacaaatgaatattatcctgtactgggtaaaaataataaggataatctaccaaataatgtgttttattatttagaatttgtaattgattcttatgaggatggcaagggtaatacaattccttataacactgttggaagatacacacttaccgaaaggaataatcctaaaggtgcatattccatacaaactacattccatacaacagatcataaggagttaggtacaccaaatgttggctatagcgctgtatctaaaggagatccaacagttatagtaggacaaaatgtaaaagtcgtaagtcatttgaatgttcgtgctgttacagaaggtggtacaacgatgatttataagtggaatacagattcgttttatctaacgaaaaatggtgcggaaacagctaagaagaatatgttaaatgaggggtatcccaacacttctgctggaagagttacaaatagtgataaacaaaaaatctattttggaatatctaaaaaaggagataattcttttgaaacactaacccaaaacaaagatgaggactatgattggtatagcacatatgatgaggcaaggaaacaaggtgaagtagctgctatcaaaaatgatatcaatgcatctatgggggatggtgaggttgtagcatggaatattcctttagaggtaaaaacaaagaaaataggtagtgttaatgaaaaaggaacgccaaatataacggttacggattcagtagtttatccttcagctgatagaaaagtaggttatagagtacgtggtgaagggaaatataataactttactgagtatgatgaaaagggaaatataacaaaactgcaatctcctgtaggaagtactgtgaattttgaaacgctaggcattatgaatggtgagacaagcagtgacgtaaaaacaaataaaaatacttattacagctcagataatgttagtgtaaccgttgataatttagtgaaattacctgatgcaatggactataattcattagatgaaaaagtagaaatgagagtgaaaataccaaaaggtcttgattatgtagtgggttctgctaaatatggtgatcaatacattgagccgaaaattgagcaacaaaatgatggaagtaatcatttgatttggcatgacacattgactcgtggtaataaaacgctcaaaaaaatcaactttgagacgagaattaatcctgtactgcttccacaaggaaatcaggtaggtttggaaattacgaatgttcttagtagtgcgatggacacgagggcagaaaaattccgaacaagttctaaaaatatttcagttgtgaaaattggtatggttggtgttagtgaaacaattgagaaagtgacagggaaaaagaacagtgactatgtggtcggtgttcaaccgtatacgacaatcaaagatgagtcacatataaaggcacttacatatgttccaagaaataaggatcataatggatctgcttttaatggtgttactttcttgaaacaaatagcactagaaaatgctaataataagaacgttgaaatatggcttaataacagctttgtcgaatcaaataatccaaacaaaattgatttaaagtcaaatggttggtatcggtatacaggagagcaggatctgtcaaaagtggtctctattttgctgtatataaatgattcattaagtagcagcgatattgtaaaaatgaatcttgtttacggcacacataaaaatgaatttggagatttttacgtaagtaaaacagtggtaaatacctctgtagattacaaattatctcctgtttctaaccaggtgaaatatacaattgtggcagatgcaaatttaggtcttagaaaaataagaatcgatactgcacctgctgatattggtttgccagtaattgtacgtttagacaaggacatcatttatgaggactctaataagagtaatgttgctgttaacttatatgataagtctgataataagttggtagacagtaaagtatatacaattcaggaattaccggaggaaataaaattcaaggtagatcctaaatttttaaagaaaaataataagagaaactacgaggttagatttgaaaaagtcaataaagaatctatttttatcgtagaagggaaaggcaaagtagatacggatggttatacttcttctgaagaaactgtaaaggcaaatacaaaagcatctactgagttaaaatataaaggcgttataatgacggagcgtgaagtcggaaaagagatggaagtcttttatgaaatacttacaattccgttaaaacagctacctaaacaaaaaactggctatggttttgagttgaaaccattagttagttataacaatgaattagcggtttcttatgatgttaaggcaaatgctttagtagataagagattaattgattctcatttgaattatgagaaaaaaggtgatcaatttgttgttcctttagaagaagctgagaaaacaggcagcacggacaaaaaaaacactgattatctttttgaattgccacatattaatgtggaacaaaaaacgggtaatttatttacagatcaacaagtaaaagaccatgatccacgtattaagaatgcaataaaggatgggaagcgaaagttatatgttccaatttgggcagatcttggagaatacaacgttttaatagcatcaggaatccctataggcgccaataaggttaactttgaggtaacacaaccattaaatttatatgcatatatgtacgggacaattggctctaaaacactgaaagatgatgaattactgttagaacctgttgatccgaaaaatcctttctcaaatggcaaaccgcctggttggtcagatgaagatgttgcttggttaaagcaatag

SEQ ID NO: 108 - DNA, 4284 bp, Bacillus Sp.
atggttgtaaagagagggggaatacgattgtggtttagaaggtcatttagtttactatttgttgttatgcttctgtttggaagcttggccgactttgtatcaattggacatgcagaaagtacatcggaccagaaacaggctcaagagaaaaaaacggacgatgtgactgtgctgcaagaaaaatcggatctgaagagtacgggaactaatccaagcgaggtggttgtagcaaatggtaaaaaaggtagtgagttgtttgattttgaagcctttattaagccttcagacattgtagatggaacagcaccttttgattcgaatgatgaagcaggtaatgattctagccctaataacggcattgtaaggacgtttgatacagtaacatatccactgaaggtgacgattaatcctaagaagaatgaaacgctaaaaaatattaagatgaaaatcaccggtacattagaaaatggaattacaaacaagcgtgttaatgcaaaatttgctgttggcggaaaagaggatttagaaaagggtattgtatcttttgatatggaatacacgttaaaggaaacaggtaactccttaatgatccctgttacagtggaagtacaaggggcggagcatggactgaaattaaaacctaatataaatatccaggttataagtgtagatgggaaagatattgcaaatgaaaatgtatcgcaatcatttgatggtattagtcccgttattacttcaggaaaggttaatgtaaaggctcgctttactgcttcttatggtggaatgcctagattggattataaggtttatgatcccaatgcaaaagaggatgatcgtacaatcatatatccagttgctttagatttatttgttaataatttaccgaaccgaactgatttacgaggggctacattccctgctggaaagattaattatcactttaatttttcaggaaaagtcgattgggattataaatcattaggtgcagaaacattgaattttgagggtcgggataaaccgataaagatttttaactatcaggctattgataaaatagtagataaagtgccacaagaaggtacggaaagttttgaaattgggatgaagggctataaagatcctcgtactgagacagcaaacagtcctaaatcatatattccaaaagataaatggaatgctagtgatattgataaatacacgattgacagtgtatgggatagtggaaaagtacgtttgaataaaccagaaattacaaaggatcgtgtaggttatacgggtagtatagaagactatgtaattggttcaaccttcccaacgatgatgtcaaggccaggttattcagtaattcctaccttcggaaagaatgaaaaagcattttcaagcacacgtttcttaatacattcaacaaatgaatattatcctgtactgggcaaaaacaataaggagaatctacctaataatgtgtattattatttagaatttgttattgattcttatgaggatggcaaggggaatacaattccttataacactgttggaagatacacacttaccgaaaggaataacccaaaaggtgcatactccatacaaactacattccatacaacagatcataaggagttaggtacaccaaatgttggctatagcgctgtatctaaaggagatccaacagttatagtaggacaaaatgtaaaagtcgttagtcatttgaatgttcgtgctgttacagaaggtggtacaacgatgatttataagtggaatacagattcgttttatctatcgaaaaatggtgcggaaacagctaagaagaacatgttaaacgagggctatcccaacacttctgcgggaagagttacaaatagtgataaacaaaaaatctattttggaatatctaaaaaaggagataattcctttgaaacactaacccaaaacaaagatgaggattatgattggtatagcgcatatgatgaggcaaggaaaaatggtgaagtagctgctatcaaaaatgatatcaatgcatctatgggggatggtgaggttgtagcatggaatattcctttagaggtaaaaacaaagaaaataggtagtgttaatgaaaaaggaacgccaaatataacggttacggattcagtagtttatccttcagctgatagaaaagtaggttatcgagtacgtggtgaagggaaatataataactttactgagtatgatgaaaagggaaatataacaaaactgcaatctcctgtaggaagtactgtgaattttgaaacgctaggcattatgaatggtgagacaagcagtgacgtaaaaacaaataaaaatacttattacagctcagataatgttagtgtaaccgttgataatttagtgaaattacctgatgcaatggactataattcattagatgaaaaagtagaaatgagagtgaaaataccaaaaggccttgattatgtagtaggttctgctaaatatggtgatcagtacattgagccgaagattgagcaacaaaatgatggaagtaatcatttgatttggcatgacacattgactcgtggtaataaaacgctcaaaaaaatcaactttgagacaagaattaatcctgtactgcttccacaaggaaatcaggtaggtttggaaattacgaatgttcttagtagtgcgatggacacgagggcagaaaaattccgaacaagttctaagaatatttcagttgtgaaaattggtatggtcggtgttagtgaaacacttgagaaagtgacagggaaaaagaacagtgactatgtggtcggtgttcaaccgtatacaacaatcaaagatgagtcacatataaaggcacttacatatgttccaagaaataaggatcataatggatctgcttttaatggtgttactttcttgaaacaaatagcactagaaaatgctaataataagaacgttgaaatatggcttaataacagctttgttgaatcgaataatccaaacaaaattgatttaaagtcaaatggttggtataggtatacaggagagcaggatctatcaaaagtggtctctattttgctgtatataaatgattcattaagtagcagcgatattgtaaaaatgaatcttgtttacggcacacataaaaatgaatttggagatttttacgtaagtaaaacagtggtaaatacctctgttgattacaaattatctcctgtttctaaccaggtgaaatatacaattgtggcagatgcaaatttaggtcttagaaaaataagaatcgatactgcacctgctgatattggtttgccagtaattgtacgtttagacaaggacatcatttatgaggactctaataagagtaatgttgctgttaatttatatgataaggctgacaacaagctggtagacagtaaagtatatacaattgaggaattaccggaggaaataaaattcaaggtaaatcctcaatttttaaagaaaaataataagagaaactacgaggttagatttgaaaaagtcaataaagaatctatttttatcgtagatgggaaaggcaaagtagatacggatggttatacttcttctgaagaaactgtaaaggcaaatacaaaagcatctactgagttaaaatataaaggcgttataatgacggagcgtgaagtcggaaaagagatggaaatcttttatgaaacccttacaattccgttaaaacagctgcctaaacaaaaaactggctatggttttgagttgaaaccattagttagttataacaatgaattagcggttccttacgatgttaaggcaaatgctttagtagataagagattaattgattctcatttgaattatgagaaaaaaggtgatcaaatggttgttcctttagaagaagctgagaaaacaggcagcacggacaaaaagaacactgattatctttttgaattgccacatattaatgtggaacaaaaaacgggtaatttatttacagatcaacaagtaaaagaccatgatccacgtattaaaaatgcaataaaggatgggaaacgaaagttatatgttcctatttgggcagatctgggagaatacaacgttttaataacatcaggaatccctataggcgctaataaagttaactttgaggtaacacaaccattaaatttatatgcatatatgtacgggacaattggctcgaaaaccctggaagatgatgaattactgttagagcctgttgatccaaaaaatcctttctcaaatggcaaaccgcctggttggtcagatgtagatgttgcttggttaaagcaatag

SEQ ID NO: 109 - DNA, 4254 bp, Bacillus Sp.
ttgtggtttagaaggtcatttagtttattatttgttgttatgcttctgtttggaagcttggccgacttcgtatcaattggacatgcagaaagtacatcggatcagaaacaggctcaagagaacaaaacaaacgatgtgactgtgctgcaagaaaaatcagatctgaagagtacgggaactaatccaaacgaggtagttgtagcaaaaggtaaaaaaggtagtgagttgtttgattttgaagcctttattaagccttcagacattgtagatgggacagcaccttttgattcgaacgatgaagcaggtaatgattctagtcctaataatggcattgtaaggacgtttgatacagtaacatatccattgaaggtgacgattaatcctaagaagaatgaaacgttaaagaatattaagatgaaaatcaccggtacattagaaaatggaattacaaacaaacgtgttaatgcaaaatttgctgttggtggtaaagaggatttggaaaagggtattgtttcttttgatatggaatacacgttaaaggaaacaggtaactccctaatgattcctgttacattggaaatacaaggggcagagcaaggactgaaacttaaacctaacattaaaatccaggttataagcgtagatgggaaagatattcaagatgaaaatgtatcacaatcatttgatgatattagtcctgttactacttcgggaaaggtgaatgtaaaggctcgttttactgcttcttatggtggaatgcccagactggattataaggtttatgatcccaatgcaaaagaggatgatcgtacaatcatatatccagttgctttagatttatttattaataatttacctaatcgaactgatttacgaggggctacattccctgttggaaagattaattatcactttaatttttcagggaaagtcgattgggataataaatcgttaggtgcagaaacattgaatttcgagggtcgggataaaccaatgaaaattttcaactatcaggctatcgataaaatagtagataaagtaccacaagaaggtacagagagttttgaaattggtatgaagggttacaaagatacccgtacagaagtagctaatagtcctaaatcctatattccaagagataaatggaatgcaagcgatattgataaatacacgattgacagtgtatgggatagcggaacagtacgattaaataaacctgaaattacaaaggatcatgtagggtatacgggtagtattgaagactatgtaataggttcaacatttccaacgatgatgtcacgccctggttcaccaacgattccgacattcggaaagaatgaaaaggcattttcaagtacaaggttcttaattcattcaactaatgagtattatccatttggtaaaaataataaggagaatctaccgaataatgtgtattactatttggaatttgttattgattcttatgaagatagtaaaggtaacacaattccttataatactgtaggaaaatacacacttactgaaagaaataatcctaaaggttcatattccatacaaactacattccatacaactgatcataaagagttgggtacaccacatgttggatatagtgttgtatctaagggagatccaacggttatagtaggacaaaaggtgaaacttataagtcacttgaatgtccgtgctgttactgagggtggtacaactatggtttataaatggaatacagattcgttttatttgaccaaaggtagtgccgagatagctagaaaggatatgttaaatcagggttatccaaatacttctggtggaagaattaaagatagtgataaacaaaaaatctattttggaatatctaaaaaagaggataattcctttgaaacactaacccaaaacaaagatgaggattataattggtatagcacatatgatgaagcaaggaaaaatggtgaagtaggtgctatcaaaaatgatattaatgcatctatgggggatggtgaggttgtagcctggaatattcctttagaggtaaaaacaaagaaaataggtagtgttaatgaaaagggtacgcccaacataacagttacggattcagtagtgtatccttcagctgacagaaaagtgggttatcgagtacgtggtgaaggaaagtataataacttcactgagtatgatgaaaagggaaatataacaaaattgcaatcccctgtagggagtactgtgaattttgaaacgctaggcattatgaatggtgagacaagtagtgatgtgaaaacaaataaaaatacttattacagttcagataatgttagtgtaaccgttgataatttagtcaagttacctgatgcaatggattataattcattagatgaaaaagtagaaatgagagtgaaaataccaaaaggtcttgattatgtagttggttctgcaaaatatggtgatcagtacatcgagccgaaaattgagcaacaaaatgatggaagtaatcatttgatttggcatgacacattgactcgtggtaataaaactcttaaaaaaatcaactttgagacaagaattaatcctgtattgcttccgcaaggaaatcaggtaggtttggaaattaagaatgttcttagtagtgcaatggacacaagggcagaaaaatttcgaacaagctctaaaaatatttcagttgtgaaaattggtatggttggtgttagtgaaacaatagagaaagtaacaggtaaaaagaacagtgactatgtggttggtgttcaaccgtatacgacaattaaagatgagtcacatataaaggcacttacatatgttccgagaaataaggatcataatggttctgcttttaatggtgttactttcttgaaacaaatagcactagaaaatgctaataataagaacgttgaaatatggcttaataatagctttgttgaatcaaataatccaaacaaaattgatttaaattcaaatggttggtataggtatacaggagagcaggatctatcaaaagtggtctctattttgctatatataaatgattcattaagtagtagcgatattgttaaaatgaatcttgtttacggcacaaataaaaatgaatttggagatttttacgtaagtaaaacagtggtaaatacctctgttgattacaaattatctcctgtttctaaccaggtgaaatatacaattgtggcagacgcaaatttaggtcttagaaaaataagaatcgatactgcacctactgatattggtttgcctgtaattgtacgtttggacaaggacatcatttatgaggactctaataagagtaatgttgctgttaacttatatgataaggctgacaataagctggtagatagcaaagtatatacaattgaggaattaccggaggaaataaaattcaaggtagatcctaaatttttaaagaaacatgataagagaaattatgaggttagatttgaaaaagttaataaagaatctatccttattttagatgggaaaggcaaagtagatacggatggttatacttcttctgaagaaactgtaaaggcaaatgctaaagcatctactgaattgaaatataaaggcgttataatgacggagcgtgaagtcggaaaagagatggaaatcttttatgaaacacttacaattccgttaaaacagctgcctaaacaaaaaactggctatggttttgagttgaaaccattagttagttataacaatgaattagcagttccttatgatgtgaaggcaaatgcatttgtagataagagactgattgattctcatttgaattatgagaaaaaaggagatcaaatggttgttccattagaagaagctgagaaaacaggcagcacggataagaagaacaccgattttctttttgaattgccacatattaacgtagaacaaaaaacaggtaatttatttaccgatcagcaagtgaaagaccatgatccacgtattaagaatgcaataaaagatgggaagcgaaagttatatgttcctatttgggcagatctgggagagtacaatgtattaatagcatcaggaatccctataggcgctaataaggttaactttgaggtaacacaaccattaaatttatatgcatatatgtacgggacaattggctctaaaacactgaaagatgatgaattactattagagcctgttgatccaaaaaatcctttctcaaatggcaaacctcctggttggtcagatgaagatgttgcttggttaaagcaatag

SEQ ID NO: 110 - DNA, 4281 bp, Bacillus Sp.
atggttgtaaagagaggaggaatacgattgtggtttagaaggtcatttagtttattatttgttgttatgcttctgtttggaagcttggccgacttcgtatcaattggacatgcagaaagtacatcggatcagaaacaggctcaagagaacaaaacaaacgatgtgactgtgctgcaagaaaaatcagatctgaagagtacgggaactaatccaaacgaggtagttgtagcaaaaggtaaaaaaggtagtgagttgtttgattttgaagcctttattaagccttcagacattgtagatgggacagcaccttttgattcgaacgatgaagcaggtaatgattctagtcctaataatggcattgtaaggacgtttgatacagtaacatatccattgaaggtgacgattaatcctaagaagaatgaaacgttaaagaatattaagatgaaaatcaccggtacattagaaaatggaattacaaacaaacgtgttaatgcaaaatttgctgttggtggtaaagaggatttggaaaagggtattgtttcttttgatatggaatacacgttaaaggaaacaggtaactccctaatgattcctgttacattggaaatacaaggggcagagcaaggactgaaacttaaacctaacattaaaatccaggttataagcgtagatgggaaagatattcaagatgaaaatgtatcacaatcatttgatgatattagtcctgttactacttcgggaaaggtgaatgtaaaggctcgttttactgcttcttatggtggaatgcccagactggattataaggtttatgatcccaatgcaaaagaggatgatcgtacaatcatatatccagttgctttagatttatttattaataatttacctaatcgaactgatttacgaggggctacattccctgttggaaagattaattatcactttaatttttcagggaaagtcgattgggataataaatcgttaggtgcagaaacattgaatttcgagggtcgggataaaccaatgaaaattttcaactatcaggctatcgataaaatagtagataaagtaccacaagaaggtacagagagttttgaaattggtatgaagggttacaaagatacccgtacagaagtagctaatagtcctaaatcctatattccaagagataaatggaatgcaagcgatattgataaatacacgattgacagtgtatgggatagcggaacagtacgattaaataaacctgaaattacaaaggatcatgtagggtatacgggtagtattgaagactatgtaataggttcaacatttccaacgatgatgtcacgccctggttcaccaacgattccgacattcggaaagaatgaaaaggcattttcaagtacaaggttcttaattcattcaactaatgagtattatccatttggtaaaaataataaggagaatctaccgaataatgtgtattactatttggaatttgttattgattcttatgaagatagtaaaggtaacacaattccttataatactgtaggaaaatacacacttactgaaagaaataatcctaaaggttcatattccatacaaactacattccatacaactgatcataaagagttgggtacaccacatgttggatatagtgttgtatctaagggagatccaacggttatagtaggacaaaaggtgaaacttataagtcacttgaatgtccgtgctgttactgagggtggtacaactatggtttataaatggaatacagattcgttttatttgaccaaaggtagtgccgagatagctagaaaggatatgttaaatcagggttatccaaatacttctggtggaagaattaaagatagtgataaacaaaaaatctattttggaatatctaaaaaagaggataattcctttgaaacactaacccaaaacaaagatgaggattataattggtatagcacatatgatgaagcaaggaaaaatggtgaagtaggtgctatcaaaaatgatattaatgcatctatgggggatggtgaggttgtagcctggaatattcctttagaggtaaaaacaaagaaaataggtagtgttaatgaaaagggtacgcccaacataacagttacggattcagtagtgtatccttcagctgacagaaaagtgggttatcgagtacgtggtgaaggaaagtataataacttcactgagtatgatgaaaagggaaatataacaaaattgcaatcccctgtagggagtactgtgaattttgaaacgctaggcattatgaatggtgagacaagtagtgatgtgaaaacaaataaaaatacttattacagttcagataatgttagtgtaaccgttgataatttagtcaagttacctgatgcaatggattataattcattagatgaaaaagtagaaatgagagtgaaaataccaaaaggtcttgattatgtagttggttctgcaaaatatggtgatcagtacatcgagccgaaaattgagcaacaaaatgatggaagtaatcatttgatttggcatgacacattgactcgtggtaataaaactcttaaaaaaatcaactttgagacaagaattaatcctgtattgcttccgcaaggaaatcaggtaggtttggaaattaagaatgttcttagtagtgcaatggacacaagggcagaaaaatttcgaacaagctctaaaaatatttcagttgtgaaaattggtatggttggtgttagtgaaacaatagagaaagtaacaggtaaaaagaacagtgactatgtggttggtgttcaaccgtatacgacaattaaagatgagtcacatataaaggcacttacatatgttccgagaaataaggatcataatggttctgcttttaatggtgttactttcttgaaacaaatagcactagaaaatgctaataataagaacgttgaaatatggcttaataatagctttgttgaatcaaataatccaaacaaaattgatttaaattcaaatggttggtataggtatacaggagagcaggatctatcaaaagtggtctctattttgctatatataaatgattcattaagtagtagcgatattgttaaaatgaatcttgtttacggcacaaataaaaatgaatttggagatttttacgtaagtaaaacagtggtaaatacctctgttgattacaaattatctcctgtttctaaccaggtgaaatatacaattgtggcagacgcaaatttaggtcttagaaaaataagaatcgatactgcacctactgatattggtttgcctgtaattgtacgtttggacaaggacatcatttatgaggactctaataagagtaatgttgctgttaacttatatgataaggctgacaataagctggtagatagcaaagtatatacaattgaggaattaccggaggaaataaaattcaaggtagatcctaaatttttaaagaaacatgataagagaaattatgaggttagatttgaaaaagttaataaagaatctatccttattttagatgggaaaggcaaagtagatacggatggttatacttcttctgaagaaactgtaaaggcaaatgctaaagcatctactgaattgaaatataaaggcgttataatgacggagcgtgaagtcggaaaagagatggaaatcttttatgaaacacttacaattccgttaaaacagctgcctaaacaaaaaactggctatggttttgagttgaaaccattagttagttataacaatgaattagcagttccttatgatgtgaaggcaaatgcatttgtagataagagactgattgattctcatttgaattatgagaaaaaaggagatcaaatggttgttccattagaagaagctgagaaaacaggcagcacggataagaagaacaccgattttctttttgaattgccacatattaacgtagaacaaaaaacaggtaatttatttaccgatcagcaagtgaaagaccatgatccacgtattaagaatgcaataaaagatgggaagcgaaagttatatgttcctatttgggcagatctgggagagtacaatgtattaatagcatcaggaatccctataggcgctaataaggttaactttgaggtaacacaaccattaaatttatatgcatatatgtacgggacaattggctctaaaacactgaaagatgatgaattactattagagcctgttgatccaaaaaatcctttctcaaatggcaaacctcctggttggtcagatgaagatgttgcttggttaaagcaatag

SEQ ID NO: 111 - DNA, 4254 bp, Bacillus Sp.
ttgtggtttagaaggtcatttagtttattatttgtttttatgcttctgtttggaagcttggccgactttgtatcaattggacatgcagaaagtacatcggaccagaaacaggctcatgagaataaaacggacgatgtgactgtgctgcaagaaaaatcagatctcaaaagtacgggtcttaatcctaacgaggtagttgtagcgaatggtaaaaaaggtagtgagttgtttgattttgaagcttttattaagccttcagacattgtagatggaacagcgccttttgattcgaacgatgaagcaggtaatgattctagccctaataatggcattgtaaggacgtttgatacagtaacatatccattgaaggtgacaattaatcctaagaagaatgaaacattaaaaaatattaagatgaaaatcaccggtacattagaaaatggaattacaaacaaacgtgttaatgcaaaatttgctgttggtggtaaagaggatttggaaaagggtattgtttcttttgatatggaatatacgttaaaggaaacaggtaactccctaatgattcctgttacattggaaatacaaggggcagagaatggactgaaactaaaacctaatattaaaatccaggttataagtgtagatgggaaagatattcaagatgaaaatgtatcacaatcatttgatgatattagtcctgttactacttcaggaaaagttaatgtaaaggctcgttttactgcttcttatggtggattacctagattagattataaggtttatgattcaaatgctaaaaaggatgaccgctctataatgtatccagttgcattagatctatttgttgataatctgcctaatcgtaatgatttaagaggagctacattcccagttgggaaaattaattatcattttaatttttcaggaaaagttgattgggatgaaaaatcattggggcaagaagcgctggattttgagggaagggatacgccaatcaaaatctttaactatcaggctattgataaaatagttgataaggttccgcaagaaaatacggaaagctttgagcttggtattaaggggtataaagatcctcgtactgaaacagctaatagtccaaaatcttatataccaaaagaaaaatggaatgcaggcgatatagataaatacacgattgatagtgtatgggatagtggtacagtacgtctgaataaacctgaaattactaagaaccgtataggatatgcgggaagtattgatgattacgttattggtagaacattcccaacaatgatgtcaagaccaaactatccagtgattcctacatttgggaagaatcaaaaggctttttcaagtacacgatttttaattcattcgcctaatgaatattatccgtttgggaaaaataataaacaaaatttacacaataacgtatattactatttggaatttgtgattgattcttatgaagatggaaaaggaaatacaattccttacaatacggtaggaagatatacacttacggaaagaaataatccgaagggatcgtattcaatacaaactacgttccacacacctgaagggaaagaacttggtacaccaaacgttggttatggtgcagtttcaaaaggtgatcccactgttattgttggacaaaaagttaaaatcataagtcatctaaatgttcgtgctgttactgagggtggaacgactatggtttataagtggaatacagattcctttaatttaacaaaaaatggtgctgatatcgccaagaaagatatgttacatcaagggtatccaaacactacaggtggaagagataaagatgttaataaacaaaaaatttattttggagtttctaaaaagaatgataattcttttgaaacaataacacaaaataaagatgaggattatgaatggtttagcacatatgatgaagctaaaacacatggtgaagttggagctatgaaaaatgatattcatgctcttatgggtgatggtgaagttgtagcatataatattcctcttgatgttaaaacaaagaaagttggtagtgttaacgaaaaaggtacaccaaacataactgtgactgattctgttgtatatcccacatctgataggaaaataggttatcgtgtacgaagtgaaggtaaatataacaatttcactgaatacgatgagaagggaaatgtaataaaacttcagtctcctgtaggaagtacagtcaactttgaaactttaggcattatgaacggtgaaacaagtagtgaggtaaaaacgaataaaaatacttattacagttcggataatgttagtgttacagttgataatttggtaaggctacctgaagcaatggactatacttctctagatgaaaaaatagagatgcgagtgaaaatacctaaaggtcttgattatgtggttggttctgctaaatatggtgatcagtacattgaaccgaaaattgagcaacagagtgatgggagtaatcatttgatttggcacgacacattgactcgtgggaataaagcactcaaaaaaatcaattttgaaactcggattaatccagtgttactaccgcaaggaaatcaggttggtctagaaattcaaaatgtaatgagtagttcaatggatactaggttagagaagtttcgaacaagctctaagaatatttcagttgtgaaaattggtatggttggtgttagtgaaacaatcgagaaagtgacaggtaaaaagaacagtgactatgtagtcggggttcaaccgtatacaacaatcaaagatgagtcacatattaaggcacttacatatgttccaaggaataaggatcataatggatctgcttttaatggtgttactttcttgaaacaaatatcactggaaaatgctaataataaaaacgttgaaatatggcttaataacagctttgttgaatcaaataatccaaacaaaattgatttaaattcaaatggttggtataggtatacaggagagcaggatctatcaaaagtggtctctattttgctgtatataaatgattcattaagtagcagtgatgttgtaaaaatgaatcttggttatggtacgtataaaaatgaatttggagatttttacgtaagtaaaacagtggtaaatacctctgttgattataaattatctccagtttctaaccaggtaaaatatacaattgtggcagatgcgaatttaggtcttagaaaaataagaatcgatactgcacctgctgatattggtttgccagttattgtacgtttagacaaggacatcatttatgaggactctaataagagtaatgttgctgttaacttatatgataaggctgataacaagctggtagacagtaaagtatatacaattgaggaattaccggaggaaataaaattcaaggtaaatcctaaatttttaaagaaaaataataagagaaattacgaggttagatttgaaaaagttaataaagaatctatccttattttagatgggaaaggtaaagtagatacggatggttatacttcttctgaagaaactgtaaaggcaaatgctaaagcatctactgagttgaaatataaaggcgttataatgacggagcgtgaagtcggaaaagagatggaaatcttttatgaaacacttacaattccgttaaaacagctgcctaaacaaaaaactggctatggttttgagttgaaaccattagttagttataacaatgaattagcagtcccttatgatgtgaaggcaaatgcttttgtagataagagattgattgattctcatttgaattatgagaaaaaaggggatcaaatggttgttccattagaagaagctgagaaaataggcagcacggataagaagaacaccgattttcttttcgaattgccacatattaacgtagaacaaaaaacaggtaatttatttaccgatcagcaagtaaaggaccatgatccacgtattaagaacgcaataaaagatgggaagcgaaagttatatgttcctatttgggcagacctgggagaatacaatgttctaatagtatcaggaatccctataggcgctaataaggttaactttgaggtaacacaaccattaaatatatatgcatatatgtatggtacgattggttctgaaacgctgaaagatgatgaaatactcttagaacctgtagatccgaaaaatcctttctcatctggcaaaccccctggttggtcagatgaagatgttgcttggttaaagcgatag

SEQ ID NO: 112 - DNA, 4281 bp, Bacillus Sp.
atggttgtaaagagaggagggatacgattgtggtttagaaggtcatttagtttattatttgtttttatgcttctgtttggaagcttggccgactttgtatcaattggacatgcagaaagtacatcggaccagaaacaggctcatgagaataaaacggacgatgtgactgtgctgcaagaaaaatcagatctcaaaagtacgggtcttaatcctaacgaggtagttgtagcgaatggtaaaaaaggtagtgagttgtttgattttgaagcttttattaagccttcagacattgtagatggaacagcgccttttgattcgaacgatgaagcaggtaatgattctagccctaataatggcattgtaaggacgtttgatacagtaacatatccattgaaggtgacaattaatcctaagaagaatgaaacattaaaaaatattaagatgaaaatcaccggtacattagaaaatggaattacaaacaaacgtgttaatgcaaaatttgctgttggtggtaaagaggatttggaaaagggtattgtttcttttgatatggaatatacgttaaaggaaacaggtaactccctaatgattcctgttacattggaaatacaaggggcagagaatggactgaaactaaaacctaatattaaaatccaggttataagtgtagatgggaaagatattcaagatgaaaatgtatcacaatcatttgatgatattagtcctgttactacttcaggaaaagttaatgtaaaggctcgttttactgcttcttatggtggattacctagattagattataaggtttatgattcaaatgctaaaaaggatgaccgctctataatgtatccagttgcattagatctatttgttgataatctgcctaatcgtaatgatttaagaggagctacattcccagttgggaaaattaattatcattttaatttttcaggaaaagttgattgggatgaaaaatcattggggcaagaagcgctggattttgagggaagggatacgccaatcaaaatctttaactatcaggctattgataaaatagttgataaggttccgcaagaaaatacggaaagctttgagcttggtattaaggggtataaagatcctcgtactgaaacagctaatagtccaaaatcttatataccaaaagaaaaatggaatgcaggcgatatagataaatacacgattgatagtgtatgggatagtggtacagtacgtctgaataaacctgaaattactaagaaccgtataggatatgcgggaagtattgatgattacgttattggtagaacattcccaacaatgatgtcaagaccaaactatccagtgattcctacatttgggaagaatcaaaaggctttttcaagtacacgatttttaattcattcgcctaatgaatattatccgtttgggaaaaataataaacaaaatttacacaataacgtatattactatttggaatttgtgattgattcttatgaagatggaaaaggaaatacaattccttacaatacggtaggaagatatacacttacggaaagaaataatccgaagggatcgtattcaatacaaactacgttccacacacctgaagggaaagaacttggtacaccaaacgttggttatggtgcagtttcaaaaggtgatcccactgttattgttggacaaaaagttaaaatcataagtcatctaaatgttcgtgctgttactgagggtggaacgactatggtttataagtggaatacagattcctttaatttaacaaaaaatggtgctgatatcgccaagaaagatatgttacatcaagggtatccaaacactacaggtggaagagataaagatgttaataaacaaaaaatttattttggagtttctaaaaagaatgataattcttttgaaacaataacacaaaataaagatgaggattatgaatggtttagcacatatgatgaagctaaaacacatggtgaagttggagctatgaaaaatgatattcatgctcttatgggtgatggtgaagttgtagcatataatattcctcttgatgttaaaacaaagaaagttggtagtgttaacgaaaaaggtacaccaaacataactgtgactgattctgttgtatatcccacatctgataggaaaataggttatcgtgtacgaagtgaaggtaaatataacaatttcactgaatacgatgagaagggaaatgtaataaaacttcagtctcctgtaggaagtacagtcaactttgaaactttaggcattatgaacggtgaaacaagtagtgaggtaaaaacgaataaaaatacttattacagttcggataatgttagtgttacagttgataatttggtaaggctacctgaagcaatggactatacttctctagatgaaaaaatagagatgcgagtgaaaatacctaaaggtcttgattatgtggttggttctgctaaatatggtgatcagtacattgaaccgaaaattgagcaacagagtgatgggagtaatcatttgatttggcacgacacattgactcgtgggaataaagcactcaaaaaaatcaattttgaaactcggattaatccagtgttactaccgcaaggaaatcaggttggtctagaaattcaaaatgtaatgagtagttcaatggatactaggttagagaagtttcgaacaagctctaagaatatttcagttgtgaaaattggtatggttggtgttagtgaaacaatcgagaaagtgacaggtaaaaagaacagtgactatgtagtcggggttcaaccgtatacaacaatcaaagatgagtcacatattaaggcacttacatatgttccaaggaataaggatcataatggatctgcttttaatggtgttactttcttgaaacaaatatcactggaaaatgctaataataaaaacgttgaaatatggcttaataacagctttgttgaatcaaataatccaaacaaaattgatttaaattcaaatggttggtataggtatacaggagagcaggatctatcaaaagtggtctctattttgctgtatataaatgattcattaagtagcagtgatgttgtaaaaatgaatcttggttatggtacgtataaaaatgaatttggagatttttacgtaagtaaaacagtggtaaatacctctgttgattataaattatctccagtttctaaccaggtaaaatatacaattgtggcagatgcgaatttaggtcttagaaaaataagaatcgatactgcacctgctgatattggtttgccagttattgtacgtttagacaaggacatcatttatgaggactctaataagagtaatgttgctgttaacttatatgataaggctgataacaagctggtagacagtaaagtatatacaattgaggaattaccggaggaaataaaattcaaggtaaatcctaaatttttaaagaaaaataataagagaaattacgaggttagatttgaaaaagttaataaagaatctatccttattttagatgggaaaggtaaagtagatacggatggttatacttcttctgaagaaactgtaaaggcaaatgctaaagcatctactgagttgaaatataaaggcgttataatgacggagcgtgaagtcggaaaagagatggaaatcttttatgaaacacttacaattccgttaaaacagctgcctaaacaaaaaactggctatggttttgagttgaaaccattagttagttataacaatgaattagcagtcccttatgatgtgaaggcaaatgcttttgtagataagagattgattgattctcatttgaattatgagaaaaaaggggatcaaatggttgttccattagaagaagctgagaaaataggcagcacggataagaagaacaccgattttcttttcgaattgccacatattaacgtagaacaaaaaacaggtaatttatttaccgatcagcaagtaaaggaccatgatccacgtattaagaacgcaataaaagatgggaagcgaaagttatatgttcctatttgggcagacctgggagaatacaatgttctaatagtatcaggaatccctataggcgctaataaggttaactttgaggtaacacaaccattaaatatatatgcatatatgtatggtacgattggttctgaaacgctgaaagatgatgaaatactcttagaacctgtagatccgaaaaatcctttctcatctggcaaaccccctggttggtcagatgaagatgttgcttggttaaagcgatag

SEQ ID NO: 113 - DNA, 4254 bp, Bacillus Sp.
ttgtggtttagaaggtcatttagtttattatttgttgttatgcttctgtttggaagcttggccgatttcgtatcaattggacatgcagaaagcacatcggatcagaaacaggctcaagagaaaaaaacggacgatgtgacggtgctgcaagaaaaatctgatatgaaaagtatgggacttgctccaggtgaagtagttgtagcaaatggtaaaaaaggtagtgatttatttgattttgaagcctttattaagccttcagacattgtagatggaacagcgccttttgattcgaacgatgaagcaggtaatgatgctagtcctaataacggtgttgtaagaacctttgatactgtaacttatccattaaaggtaacgatcaacccgaaaaaacatgacaagctgaaagatattaagctgagaatcaccggtacactggaaaatggaattaccaacaaacgtgtaaatgcaaaatttgctgttggtggtaaagaggacttggaaagtggtgttgtttcttttgatatggaatacacgttaaaagaaacgggtaactctttaatgattcctgttactgttgaagtacaaggtgcggagcatggcttgaaattgaagcctaatatcaatattcaggttgtaagtgtcgatgggaaagatattacaaatgagggtatatcacaatcatttaatgatattagtcctgttactacttcaggaaaagttaatgtgaaggctcgttttactgcttcttatggaggattacctagattagattataaggtttatgattcaaatgctaaaaaggatgaccgttctataatgtatccagttgcattagatctatttgttgataatctgcctaatcgtaatgatttaagaggagctacattccctattggaaaaattaattatcattttaatttttcggggaaggttgattgggatgaaaaatcattggggcaagaaacactagattttgaaggaagagatatgccaatcaaaatctttaactatcaagctattgataaaatagttgataaagtaccgcaagaaaatacggaaagttttgagcttggtatgaaaggttataaagatcctcgtaccgaaacagccaatagcccaaaatcttatataccaaaagataaatggaatgcaagtgatattgataaatacacgattgatagtgtatgggatagtggtatagtacgtctgaataaacctgaaattactaagaatcgtataggatatgcgggaagtattgatgattatgttataggtagaacattcccaacaatgatgtcaagaccaaactatccagtgattcctacattcgggaagaatcaaaaggctttttcaagcacacgctttttaattcattcgccaaatgaatattattcgtttggaaaaaataataaacaaaatttacctaataacgtatattactatttggaatttgtaattgattcttatgaagatggaaaaggaaatacaattccttacaatacggtaggaagatatacacttacagaaagaaataatccaaagggatcgtattcgctgcaaactacattccacacacctgaagggaaagaacttggtacaccaaacgttgggtatagcgcagtttcaaaaggtgatccaacagttatagtagggcaaaaagtgaaaattataagccacttaaatgttcgtgctgttactgaaggtggaacgactatggtttataagtggaatacagattcctttgatttaacaaaaaacggtgcggatattgccaagaaagatatgttatatcaagggtatcccaacactactggtggaagagataaagatgttaataaacaaaaaatttattttggagtttctaaaaagaatgataattcttttgaaacaataacacaaaataaagatgaggattatgattggtatagcacatatgatgaagctaaaacacatggtgaagtaggagctataaaaaatgatattcacgctctcatgggtgatggtgaagttgtagcatataatattccgcttgatgttaaaacaaagacagttggtagtattaacgaaaaaggtacaccgaacatagcggttactgattcggttgtatatcctacagctgatagaaaagtaggatatcgtgtacgaggtgaaggtaaatataacaatttcactgaatacgatgaaaaaggaaatgtaacaaaacttcagtctcctgtaggaagtacagtcaattttgaaacgctaggcattatgaacggtgaaacaagtagtgaggtgaaaacaacccaaaatacttattacagttccgataatgttaatgtaacagttgataatttagtaaggctgcctgaagcaatggactttacttcccttgatgaaaaagtagaaatgcgagtgaaaataccaaaaggtcttgattatgtagttggatctgctaagtacggtgatcaatatgttgagccgaagatagaacaacaaaatgatggaagtaatcatttaatttggtatgacacattgactcgtggtaataaagcacttaaaaaaatcaactttgagactcgtattaatccagtgttgctgccgcagggaaaccaggtaggactagaaattcaaaatgtaatgagtagctctatggatactagattagagaagtttcgaacaagctctaagaatatttcagttgtgaaaattggtatggttggtgtcagtgaaacaatagagaaagtaacagggaaaaagaacagtgactatgtggtcggtgttcaaccatataccacgattaaagatgagtcgcatataaaggcacttacttatgttcctagaaataaggatgaaaatggatcagcttttaacggtgttactttcttgaaacaactaacactagaaaatgccaataataaaaacgttgaaatatggctcaataacagctttgttgaatcaaataatccaaacaaaattgatttaaaatcaaatggttggtacaggtatacaggagagatggatctatcaaaagtggtctctattttgctgtatgtaaatgattcattaagcagcagtgatgtggtaaaaatgaaccttgtttacggaacacataaaaatgaatttggagatttttatgtgagtaagacagtggtaaacacttctgttgattacaaattatctcctgtttctaaccaggtaaaatacacaattgtagcggatgcgaacttgggacttagaaagataagaattgatactgcacctgctgagattggacttcccgtaactgtacggttagataaggacattgtgtatgaggattcaaataatgaaaagctgactgttaacctatatgacaaagctgataataagcttgttggcagcaaagtttacacgattggggaactacctgaagaaattaaattcaaagtagatccaaagtttttaaagaaaaataataagagaaactatgaagtcagatttgaaaaagtaaataaagaatctgttcatgttttagatgggaaaggcaaagtagatacagacggttatacctcttctgaagaaagtattaaggtaaatgcgaaagaatctactgagttgagatataaaggcgctattatgacggaacgtgaagtcggaaaagagatggaaatcttttatgagacacttacaattccgttaaaacagttgcctaaacaaaaaactggctatggttttgagttgaaaccattagttagttataacaatgaattagcagtcccttatgatgttaaggcaaatgctttagtagataagagattaattgattctcatttgaattatgagaaaaaaggagatcaaatggttgttccgttagaagaagctgagaaaacaggcagcacggataagaagaacaccgattttctttttgaattgccacatattaatgtggaacaaaaaacgggtaatttatttacaaatcagcaagtaaaagaccatgatccacgtattaagaatgcaataaaagatggaaagagaaagttatatgttccaatttgggcagaactgggagaatataatgttttaatagcatcaggaatccctataggcgctaataaggttaactttgaggtaacacaaccactaaatttatatgcatatatgtacggaacaattggctctgaaacgctgaaagatgatgaattactattagaacctgttgatcccaaaaatcctttctcaaatggcaaacctcctggttggtcagatgaagatgttgcttggttaaagcaatag

SEQ ID NO: 114 - DNA, 4248 bp, Bacillus Sp.
ttgtggtttagaaggtcatttagtttactatttgttgttatgcttctgtttgcaagtttggctgactttgtatcaattggacatgcagaaagtacatcggaccagaaacaggctcaagagaaaaaaacggacgatgtgactgtgctgcaagaaaaatcggacctgaaaagtacaggaattaatccaaacgaggtagttgtagcaaatggtaaaaaaggtagtgagttgtttgattttgaagcctttattaagccttcagacattgtagatggaacagcaccttttgattcgaatgatgaagcaggtaatgattctagccctaataatggcattgtaaggacgtttgatacagtaacgtacccattgaaagtgacgattaatcctaagaagaatgaaacgttaaaaaatattaagatgaaaatcactggtacattagaaaatggaattacaaacaagcgtgttaatgcaaaatttgctgttggtggtaaagaggatttggaaaagggtattgtttcttttgatatggaatacacgttaaaggaaacaggtaactccttaatgattcctgttacggtggaagtacaaggggcggagcatggattgaaattaaaacctaacattaaaatccaggttataagtgtagacgggaaagatattgcaaatgaaaatgtatcgcaagcatttgatgatattaatcctgttacggcttctggaaaggtaaatgttaaggcgaaattttcaactcactatgcaggtatgccgagattgtcttattcagtattcaacccgaaagtagataaggatgatcgttcttttatctttccagttgtattatctttatttgtagataatcttcctaaccgtagcgatattaggggtgctacatttcctgctggaaaagtaaattatcactttgattttagtggacgtgttgattgggattctaaatcaatgggagtagataagttggattttgaaaggaaagatactccttttacaatttttaactatcaagatattgataatataagcaaaaaaatccctcaacccaatacagaaagctttgaaattggattggatagttatgaagatgtgcgtacagtccaatcaggaagtgcaaaatcttatattcctaaagaaaaatggaatgctagcgatattgaaaaatatacgattgatagcgtttgggatagtggtattacacaaataagcaaaccgaaagtttcaaaagatgttataaattatgaagggaacattagtgactttactattggttcaacgttcccgacaatgatttcacatgacaatcgagttgtggcttttaataaaaatcagaaagctttcgctacaactaggtttttaattcatacaccaaatgagtactaccctttagcgaaaaataataagattaacaaggctaataatgtttattatgatttgaaatgtattattgactcttatgaggatagtaaaggcaatgtagtaccatataatactacagctgctgtaactattacagaaaggaataatcccaaaggttcgtattcaattcaaactacattccatacgcctgaaggaaaagaattaggaacaccaaatattggatacagtgctgtatctaaaggtgatccgactattatagtaggacaaagggtaaaagtggtaagtcatttaaacgttcgtgctgttacagaaggtggcacaactatggtttacaaatggaatacggattcgttttatttaacaaagcaatatgcagaagcggcaaaaacaaatatgttaaatgaagggtatccaacatcttcaggaggaagagtcaaaaatagtgataagcaagttatttcttttggaatagcaaagaaaaatgacaattcttttgaagctctaacccaaaataaggctgaagattatgaatggtatagcacatatgatgaagctagaaaacatggtgaagttggagcaatcaagaatgacattaatgcagtaatgggcgatggtgaggttgtagctagctatattccttttgacgtcaagacgaagaagattggtagtcttaatgaaaaaggaacaccgaatataaccgttactgattcagttgtctatccaacagcagatcggaagattggttatcgtattcgtgaagatggtaaatacaacaactttacggagtacgatgaaaatggtaatttaactaaattacaatcgcctgtgggtagtacaattaactttgaaacattgggtattatcaatggtgagacgagcagtgacataaagacaaataaaaacacatattacagctcggataatgtgaatattacagttgataatcttgcaaaactaccagcggagacggattttaattctttagatgaaaaagtagaaatgagagtaaaaatacctaaaggtcttgattatgtagttggatctgctaaatatggtgatcaatatgttgaaccgaagatagaacagcagagtgatggaagtaatcatttggtttggtatgacacattgacgcgtggtaataaggcactcaaaaaaataaactttgagactcgtattaatccagtattgctagcgcaaggaaaccaggtaggactagaaatccaaaatgtaatgagtagttctatggatactagattagagaagtttcgaacaagctctaagaatatttcagttgtgaaaattggtatggttggtgttagtgaaacaattgagaaagtgacagggaaaaagaacagtgactatgtggtcggtgttcaaccgtatacgacaattaaagatgagtcacatattaaggcacttacatatgttccaagaaataaggatcataatggatctgcttttaatggtgttactttcttgagacaaatagcactagaaaatgctaataataagaacgttgaaatatggcttaataacagctttgttgaatctaataatccaaacaaaattgatttaaagtcaaatggttggtataagtatacaggagagcaggatctatcaaaagtggtctctattttgctgtatataaatgattcattaagtagcagcgatattgtaaaaatgaatcttgtttacggcacacataaaaatgaatttggagatttttacgtaagtaaaacattggtaaatacctctgtagattacaaattatctcctgtttccaaccaggtgaaatatacaattgtggcagatgcaaatttaggtcttagaaaaataagaatcgatacggcacctgctgatattggtttgccagtaattgtacgtttagacaaggacatcatttatgaggactctaataagagtaatgttgctgttaacttatatgataagtctgataataagttggtagacagtaaagtatatacaattcaggaattaccggaggaaataaaattcaaggtagatcctaaatttttaaagaaaaataataagagaaactacgaggttagatttgaaaaagtcaataaagaatctatttttatcgtagatgggaaaggcaaagtagatacggatggttatacttcttctgaagaaactgtaaaggcaaatacaaaagcatctactgagttaaaatataaaggcgttataatgacggagcgtgaagtcggaaaagagatggaagtcttttatgaaacacttacaattccgttaaaacagctacctaaacaaaaaactggctatggttttgagttgaaaccattagttagttataacaatgaattagcggtttcttatgatgttaaggcaaatactttagtagataagagattaattgattctcatttgaattatgagaaaaaaggtgatcaatttgttgttcctttagaagaagctgagaaaacaggcagcacggacaaaaagaacactgattatctttttgaattgccacatattaatgtggaacaaaaaacgggtaatttatttacagatcaacaagtaaaagaccatgatccacgtattaagaatgcaataaaggatgggaagcgaaagttatatgttcctatttgggcagatctcggagaatacaacgttttaatagcatcaggaatccctataggcgccaataaggttaactttgaggtaacacaaccattaaatttatatgcatatatgtacgggacaattggctctaaaacactgaaagatgatgaattactgttagaacctgttgatccgaaaaatcctttctcaaatggcaaaccgcctggttggtcagatgaagatgttgcttggttaaagcaatag

SEQ ID NO: 115 - DNA, 4248 bp, Bacillus Sp.
ttgtggtttagaaggtcatttagtttattatttgttgctatgcttctgtttggaagcttggctgacttcgtatcaattggacatgcagaaagcacatcggatcagaaacaggctcaagagaaaaaaacggacggtgtgactgtactgcaagaaaaatcagatatgaaaagtatgggacttgctccaggtgaagtagttgtagcaaatggtaaaaaaggtagtgagttgtttgattttgaagcctttattaagccttcagacattgtagatggaacagcgccttttgattcgaacgatgaagcaggtaatgattctagtcctaataatggcattgtaaggacgtttgatacagtaacatatccattaaaggtgacgattaatcctaagaagaatgaaacgctaaaaaatattaagatgaaaatcaccggtacattagaaaatggaattacaaacaaacgtgtaaatgcaaaatttgctgttggtggtaaagaggatttggaaaagggtattgtttctttggatatggaatacacgttaaaggaaacaggtaactccttgatgattcctgttacagtggaagtacaaggggcagagcatggattgaaattaaaacctaacattaaaatccaggttatgagtgtggatgggaaagatattatgaatgaaaaagtatcgcaatcattcgatgatattagtcctgttacggcttctggaaaagtaaatgttaaggcgaaattttcaactaactatgcaggtatgccgagattgtcttattcagtattcaatccgaaagtggataaggatgatcgttcttttatctttccagttgtattatctttatttgtagataatctccctaatcgtagcgatataaggggagctacattccctgttggaaaagtcaattatcactttgattttagtggacgtgttgattgggattctaaatcaatgggagtagataaattggattttgaggggaaagatactccttttaaaattttcaactatcaagctattgataatataagcaaaaaaatcccacaacccaatacagaaagctttgaaattgggttggaaagttatgaagatgtgcgtacaatccaatcaggaagtgcaaaatcttatattcctaaagaaaaatggaatgctaatgatattgataactacacgattaatagtgtttgggatagtggtattactcaaataagcaaaccgaaagtttcaaaagatgttataaattatgaagggaatgttagtgactttactattggttcaacgtttccaacaatgatttcacatgacagtcgggttgtggcttttagtaaaaaccagaaagcctttgcaacatcaaggtttttaattcatacaccaaatgagtattatcctttagcgaaaaataataagatcaacaaggctaataatgtttattatgacttgaaatgtattattgactcctatgaggatagtaaaggaaatgtagtaccttataatactacagctgctgtaacgattacggagaggaataatccaaaaggatcatactcaatacaaactacattccatacacctgaaggaaaagaattaggtacaccaaacattgggtatagtgcagtttctaaaggtgatccaactattatagtaggacaaaaagtgaaagtggtgagccatttaaacgttcgtgctattacagaaggtggcacgactatggtttacaaatggaatacggattcgttctatttaacaaaacaatatgcagagtctgcaaaagcaaatatgttaaatgaaggatacccaacatcatcgggaggaagagttaaaaatagtgataaacaagttatttcatttggagtcgcaaagaagaatgataattcttttgaagctttaacccaaaataaggctgaagattatgaatggtatagcacatatgatgaagctagaaaatatggtgaagttggagcgattaagaatgacattaatgcggtaatgggtgacggtgaagttgtagcaagttttattccttttgatgttaagacaaaaaaaattggtagtcttaatgaaaaaggaacaccgaatataacggttactgattcagttgtttatccaacagcagaccgaaaagttggttatcgtgttcgtgaagatggtaaatataacaacttcacagagtacgatgaaaatgggaatttaaccaaattacaatcaccagtgggtagtacaatcaattttgaaacattgggcataatcaatggtgaaacgagcagtgatataaagacaaataaaaacacatattacagctccgacaatgttagtgtaacagttgataatcttgtgaaattaccagcggagacggattttaactctttagatgaaaaagtagaaatgcgagtgaaaataccaaaaggtcttgattatgtagttggatctgctaagtacggtgatcaatatgttgagccgaagatagaacaacagagtgatggaagtaatcatttgatttggcatgacacattgactcgtggtaataaagcactcaaaaaaatcaactttgagactcgtattaatccagttttgctgccgcaaggaaaccaggtaggactagaaattcaaaatgtaatgagtagttctatggatactagattagagaagtttcgaacaagctctaagaatatttcagttgtgaagattggtatggtcggtgttagtgaaacaatagagaaagtaacaggtaaaaagaacagtgagtatgtggttggtgtccaaccatataccacgattaaagatgagtcacatataaaggcactcacatatgttcctagaaataaggatcaaaatggttctgcttttaatggtgttactttcttgaaacaaatagcactagacaatgataataataagaacgttgaaatatggcttaataacagctttgttgaatcaaataatccaaacaaaattgatttaaaatcaaatggttggtataggtatacaggagagcaggatttatcaaaagtggtctctatttttctgtatataaatgattcattaagtagcagtgatattgtaaacatgaaacttgtttacggaacgtataagaatgaattcggagatttttacgtgagtaagacagtagtaaatacctctgttgattacaaattatctcctgtttctaaccaggtaaaatatacaattgtggcagatgccaatttgggtcttagaaaaataaggatcgatactgcacctgctgatattggtttgccagtaagtatacgcctagacaaggatatcgtttatgaggactcaaataagagtaatattactgttaacttatatgataaggctgacaacaaactagtagctagtaaggtgtatacaattgaggaattaccggaggaaataaaattcaaggtagatcctaaatttttaaagaaaaataataagagaaactacgaggttagatttgaaaaagttaataaagaatctattctcatcgtagaagggaaaggcaaagtagatacagatggttatacttcttctgaagaaactttaaaggcaaatgctaaagcatctactgagttgctatataaaggcgttattatgacggagcgtgaagtcggaaaagagatggaaatcttttatgaaacccttacaattccgttaaaacaactgcctaaacaaaaaactggctatggctttgagttgaaaccattagttagttataacaatgaattagcagtcccttatgatgttaaggcaaatgctttagtagataagagattaatagattctcatttgaattatgagaaaaaaggagatcaaatggttgttccgttagaagaagctgagaaaacaggcagcacggataagaagaacaccgattttctttttgaattaccacatattaatgtggaacaaaaaacgggtaatttatttactgatcagcaagtaaaagaccatgatccacgtattaagaatgcaataaaggatgggaagcgaaagttatatgttccgatttgggcagacctgggagaatataatgttttaataacgtcaggaatcactataggcgctaataaggttaactttgaagtaacacaaccattaaatttatatgcatatatgtacgggacaattggctctaaaacactggaagatgatgaattactcttagaacctgtagatccgaagaatcctttctcaaatggcaaacctcctggttggtcagatgaagatgttgcttggttaaagcaatag

SEQ ID NO: 116 - DNA, 4257 bp, Bacillus Sp.
ttgtggattagaaggacatgtagtttattgcttgtttttatagttctattaggaaatcttgttgattctgtctctattgggtatgcagaaagtgcatcaaatcaagaacagggacaagaaaaaaaagttgaagatgtgactgtattgcaagaaaaatcagatatgaatactatgggattatccccgaatgagttagtcatagctgatggtaaaaagggtagcgatctatttgattttgaagcatttattaagccttcagacatcgtagatggaactgctccatttgattcaaatgatgaagcgggtaatgattctagtccgaataatggtattgtaaggacgtttgataccgttacctatccattaaaagtaacaattaatccgaaaagacatgatcagttgaagaatattaagctgaagattacgggtacattggaaaatggaattacaaataaacgtgtaaatgcaaaatttgctgtaggtggtaaagaggatttagagaaggggattgtttcttttgatatggaatacatgttaaaagaaacaggtaactctttaatgattcctgttactgttgaagtacaaggagcagaacacgaattgaagttaaaacctaatataaaaatccaagttatgagcgtagatgagaaagatattacaaatgaaaatatctcacagtcatttgatgatataagtccagttactacttcagggaaggtaaatgtaaaagctcgttttactgcatcttatggtggattacctagattagattataaagtctatgactctaatgcaaaaaaggatgatcgttctattatgtatccagttgcattagatttatttattaacaatcttcctaatcataaagatttaaggggtgccacatttcctagtgggaaaattaattatcactttaatttttcaggaaaagttgactgggatgagaaagcattaggtcaggaaccacttgatttcgaaggaagggatacaccaattaaaatctttaattatcaagctatagataaaatagttgataaagtatcgcaagaaaatacggagagttttgaaattggtatgaagggttataaagattctcgcacagaagttgctaatagtccgaaatcgtatattccaaaagataaatggaatgcaagtgatattgataaatacacgattgatagtgtatgggacagtggtgtagtgtatttgaataaacctgaaattactaagaatcgtatagcatatgcggggagcattaaggattatattattggcacgacttttccgacgatgatgtcaagacctaattatccagtcatccctacatttggaaaggatgagagggcgttctcaagtacacgttttctaattcattcatcaaatgaatattatccatttggtaaaaataataaatctaatttacccaataacgtgtattattatttggaatttgtgattgactcttatgaagatggaaaaggaaatacagttccttataatacggtaggaagatacacacttacagaaagaaataacccaaagggagcatattcgctacaaactacatttcatacaccagaaggaaaagagctaggtacaccaaatgttggatatggtgcggtctccaaaggtgatccaactgttatagttggtcaaaaggtaaaaattataagccatttaaatgttcgtgctgtcaccgaaggtggtactactatggtttataagtggaatacagattcattttatttaaccaaaaacggtgctgaaattgctaagaaagatctattaaatcaaggttatcccaatactacaggtggaagagataaggatgttaataaacaacaaatatattttggagtttctaaaaataatgataactcttttgaatcactaacacaaaatagggatgaggattatgattggtatagcaaatatgatgaagctaaaacccatggtgaaattggggctataaagaatgatattaatgcgcttatgggtgatggtgaggtggtagcatataatattccactagatgttaaaacaaagaaaattggtagtgttaatgaaaaaggtacaccaaacataacggttacggattcagtcgtatatccggcagctgatagaaaagtaggctatcgtgtaagaagtgaagggaaatataataatttcacggaatacgatgaaaagggaaatataacaaagctacagtctccggtaggaagtacagttaactttgaaacattgggtattatgaacggtgaaacgagtagtgaggtgaaaacgaataaaaacacttattacagctcagacaatgttagtataacaattgataatttagctaaattgcctgaagcaatggattttacttccttagatgaaaaggtagaaatgcgggtgaaaatacccaaaggacttgattatgtagtgggatctgctaagtacggtgaaaaatacgttgaacccaagatagaacaacaaagtgatggaagtaatcatttgatctggtatgacacattgacgcgaaataataaggtactcaaaataataaattttgaaactcgcattaatccggtgttgcttccgcagggaaatcaggtaggattagagatccaaaatgtaatgagtagtactatggatactagattagagaagtttcgaacaagctctaagaatgtttctgttgtgaaaatcggtatgattggtgttagtgaaaccataaagaaagtagcaggtaaaaagaatagtgactatgagattggcgttcagccatatacaacaattaaagatgaagcacatgtaaaggcactcacatatgttcctaggaataaggatgaaaatggatctgcctttaatggtgttacttttttaaaacagttgacattagaaaatgctaataataaaaatgttgaaatgtggttgaataataactttattgaatcgaataatccaaacaaaattgatttacagtcaaatggttggtataggtatacaggagagcaggatttatcaaaagtggtctctattttgttatatgtaaaggattcattaagtagcagcgatgttgtgaaaatgaaccttgtattaggtacatataagaatgattttggcaatcaatatgtaagtaaaacgattgttaatacttctgttgactataaattatcgcctgtttcaaaccaggtaaagtatacaattgtagcagatgttaatttgggtcttagaaaaataaggattgatactgcgcctgctgatactggattgccagtaagcataaggttagacaaggatattgtttatgaggattcaaataagagtaaagttgctgttaacttatacgacaaggtggataataaacttgtaggtagcaaggtgtatacaattgaggaattacctgaagagattgagttcaaagtaaatcctgggttcttaaagaaaaataataagagaaattatgaagtaagatttgaaaaagtaaataaagaatctattcttatcatggatggaaaagaaaaagtagatacagatggctatacatcctctgaggagactgtaaaagtaaatgctaaagaatctaatgagctaaagtatagcggtgttattatgaccgagcgtgaaatcggaaaagagatggaggtcttctatgaaacgctcaaaatgccattaaaacagttgccaaaacaaaaaacaggttatggttttgagttgaaaacagaagccagttataacaatgaattggcagctgtatttgatatcaaggcaaatgctttagtggataagaggttaattgactcgtatttaaattatgagaaaaagggaacaaaaattgtcattcctttagaagaaactaagaaaactggtagtacagataaaaagaatatggattttctatttgagttatcacatattaatgtagaacaaaaaacagggaatctatttacagatcaacaagtgaaagagcatgattcgcgtattaagaacgctataaaagatggaaagagaagattgtatgtcccaatatgggcggatcttggaacatacgatgttttcgtagtctcgggaattcctataggagttaataagattaattttgaggtaatgcagccattacaattatatgcatatatgtacggtaccattgggtctagaacgttaaaagatgatgaattactaatagaacctgtggacccaaaaaatcctttctcaaatggtaaaccttccgattggtcagatgaagatattgcgtggcttagaaaagattaa

SEQ ID NO: 117 - DNA, 4275 bp, Bacillus Sp.
atggttgtaaagagaggaggaatacgattgtggcttagaaggtcatttagtttattatttgttgttatgcttctgtttggaagcttggccgacttcgtgtcaattgggcatgcagaaagtacatcggatcagaaacaggctcaagagaaaaaaatggacgatgtgactgtgctgcaagaaaaatcggatatgaaaagtatggggcttgatccaaacgaggtagttgtagctgatggtaaaaaaggcagtgagttgtttgattttgaagcctttattaagccttcagacattgtagatggaacagtgccttttgataagaacgatgaagcaggtaatgattctagtcctaataatggcattgtaaggacgtttgatacagtaacatatccattgaaggtgacaattaatcctaagaagaatgaaacgctaaaaaatattaagttgaaaatcaccggtacattagaaaatggaattacaaacaaacgtgttaatgcaaaatttgctgttggcggtaaagaggacttggaaagtggtgttgtttcttttgatatggaatacacgttaaaagaaacgggtaactctttaatgattcctgttactgttgaagtacaaggtgcggagcatggattgaaattaaaacctaacattaaaatccaggttatgagtgtggatgggaaagatattacgaatgaaaaagtatcgcaatcgttcgatgatattagtcctgttactgcttctggaaaagtaaatgttaaggcgaaattttcaactaactatgcaggtatgccgagattgtcttattcagtattcaatccgaaagtggataaggatgatcgttcttttatctttccagttgtattatctttatttgtagataatctccctaatcgtagcgatataaggggagctacattccctgttggaaaagtcaattatcactttgattttagtggacgtgttgattgggattctaaatcaatgggagtagataaattggattttgaggggaaggatactccctttaaaatcttcaactatcaagctatcgataatataagcaaaaaaatcccacaacccaatacagaaagctttgaaattgggttggatagttatgaagatgtgcgtacaatccaatcaggaagtgcaaaatcttatattcctaaagaaaaatggaatgctagtgatattgataactacacgattaatagtgtttgggatagcggtattactcaaataagcaaaccgaaagtttcaaaagatgttataaattatgaagggaatattagtgactttactattggttcaacgttcccaacaatgatttcacatgacagtcgggttgtggcttttaataaaaatcagaaagcttttgcaacaacaagatttttaattcatacaccaaatgagtattatcctttagcgaaaaataataagatcaacaaggctaataatgtttattatgatatgaagtgtattattgactcttatgaggatagtaaaggaaatgtagtaccttataattctacagctgctgttacgattacagagagaaataatccgaagggatcatactcaatacagaccacattccatacgcctgagggaaaagagctgggaacaccaaatatcggatacaatgttgtatctaaaggtgatccgactattatagtagggcaaaaagtaaaagtggtaagtcatttaaacgttcgtgctgtcacagaaggtggcacaactatggtttacaaatggaatacggattcgttctatttagcaaagcaatatgcagaatcggcaaaagcaaatatgttaaatgaaggatacccaacatcttcaggaggaagagttaaaaatagtgataagcaagttatttcatttggaatagcaaagaaaaatgacaattcttttgaagctctaacccaaaataaggctgaagattatgaatggtatagcacatatgatgaagctagaaaatatggtgaagttggagcgattaagaatgacattaatgcggtaatgggtgacggtgaggttgtagcaggttttattccttttgatgtcaagacgaagaaaattggtagtcttaatgaaaaaggaacaccgaatataacagttactgattcagttgtttatccaacagcagaccgaaaagttggttatcgtgttcgtgaagatggtaaatataacaacttcacggagtacgatgaaaatgggaatttaaccaaattacaatcaccagtgggtggtacaatcaattttgaaacattgggcataatcaatggtgaaacgagcagtgatataaagacaaataaaaacacatattacagctccgacaatgttagtgtaacagttgataatcttgcgaaattaccagcggagacggattttaactctttagatgaaaaagtagaaatgcgagtgaaaataccaaaaggtcttgattatgtagttggatctgctaagtacggtgatcaatatgttgagccgaagatagaacaacaaaatgatggaagcaatcatttgatttggcatgacacattgactcgtggtaataaagcactcaaaaaaatcaactttgagactcgtattaatccagtgttgctgccgcagggaaaccaggtaggactagaaattcaaaatgtaatgagtagttctatggatactagattagagaaatttcgaacaagctctaagaatatttcagttgtgaaaattggtatggttggtgtcagtgaaacaatagagaatgtaacagggaaaaagaacagtgactatgtggtcggtgttcaaccatataccacaatcaaagatgagtcacatataaaggcacttacatatgttcctaaaaataaggatgaaaatggatctgcttttaacggtgttactttcttgaaacaactaacattagaaaatgccaataataaaaacgttgaaatatggctcaataacagctttgttgaatcaaataatccaaacaaaattgatttgaaatcaaatggttggtacaggtatacaggagagatggatctatcaaaagtggtctctattttgctgtatgtaaatgattcattaagcagcagtgatgtggtaaaaatgaaccttgtttacggaacacataaaaatgaatttggagatttttatgtgagtaagacagtggtaaacacttctgttgattacaaattatctcctgtttctaaccaggtaaaatacacaattgtagcggatgcgaacttgggacttagaaagataagaattgatactgcacctgctgagattggacttccagtaaccgtacggttagataaagatattgtgtatgaagattcaaataagagtgaagtcgctgttaacttgtatgataaagctgataaaaagcttgttggtagccaggtatttaccattggggaactacctgaagaaattaaattcaaagtagatccaaagtttttaaagaaaaataataagagaaactatgaagtcagatttgaaaaagtaaataaagaatctattcatgttttagatgggaaaggcaaagtagatacagacggttatacctcttctgaagaaagtattaaggtaaatgcgaaagaatctactgagttgaaatataaaggtgttattatgacggaacgtgaagtcggaaaagagatggaaatctttaatgaaacacttacaattccgttaaaacagctgcctaaacaaaaaactggttatggttttgagttaaaaccattagttagttatagcaatgaattagcagtcgcttatgatattaaggcaaatgctttagtagataagagattaattgattctcatttaaattatgagaaaaagggagatcaaattgttgttcccttagaagaagctgagaaaacaggcagctcggataagaagaataccgatttcctatttgaattaccgcatattaatgtggaacaaaaaacgggtaatatatttacagatcagcaagtaaaagaccatgatccacgtattaagaatgcaataaaagatggaaagcgaaagttatatgttccgatttgggcagacctgggagaatacaatgttctaacagcatcaggaatccctataggtgctaataaagttaactttgaggtaacgcaaccattaaatttatatgcatttatgtacgggacaataggctctaaaacgctgaaagatgatgaattactcttagagcctgttgatccgaaaaatcctttctcaaatggcaaaccgcctggttggtcagatgaagatgttgcttggttaaagcaatag

SEQ ID NO: 118 - DNA, 4176 bp, Bacillus Sp.
atgaataaagaggcagtacaagcaaagaaaacggatgatgtaacggttttacaagaaaaatcagatttggaaagcatgggtgtgactcccaatgaggtagttgttgcagacggtaaaaaaggtagtgaattgtttgattttgaagcgtttattaagccttcagacatcgtagatggtacagcgccttttgattcaaacgatgaagctggcaatgattctagcccgaataatggaattgtaagaacgtttgatacagtaacttatccattaaaggtgacaatcaaccccaaaaaccacaatcagctaaaaaatattaagttgagaattacgggtacattggaaaatggaatcacaaacaaaagagtaaatgctaaatttgctgttggtggtaaagaggatttggaggagggagttgtttcttttgatatggaatacatgctaaaagaaacaggtaactctttaatgattcctgttacagtggaagtacaaggggcagaacataacttgaaattgaagcctaacattaaaattcaggtcatgagtgttgaagagaaagatattacaagtgaaaatgtatcacaatcatttaaaaatattagcgctgttactacgtcaggaaaagtaaatgtaaaggctcgttttactacttcttatgctggattacctagattagattataaggtttataatcccgatgcaaaaaacgatgatcgtacaatcatatatcctactgcattagatttatttatcaataatttaccgaatcgaactgatttaaggggagctacatttcctgttggaaagattaattatcactttaatttttctggaaaggttgattgggataataactcgttaggttcagaaacattagattttgaagggcgagataagctgattaagatatttaactatcaagctattgataaaatagttgataaaataccgcaagaaggtacagaaagttttgagattggtatgaaaggttataaagatcctcgtactgaatcagcaaacagtcccaaatcatatattccaaaagataaatggaacacgagtgatattgataaatatacgattgacagtgtgtgggatagtggggtggtacgattaaataaaccgcaaatcactaaagaacgcgtagaatatactggtagtatagaagattacgttataggctcaacctttccaacgatgatgtcaagaccgaattacccgataattcctacatttggaaagaatgagaaggcattttcaagtacacgttttttaattcattcagcaaatgaatattattcatttggtaaaaataataaggataatctaccgaacaatgtgtattattatttggagtttgttattgattcttatgaagacggaaaaggaaacacggtaccttataatacagtagcaaaaacaactctttctgaaaggaataatcctaaaggtgcctattctatacaaacaacatttcattcaccagagggtaaagagcttggcacaccaaatgtagggtatacaattgtatctaaaggtgatccaacagttatagtgggacaaaatgtaaaaatagtaagtgacttaaatgttcatgcggttactgaaggtggggcgatgatggtttataagtggaaccctgattcgttctatttatcaaaagattatgctgaacaagccaaaaatcaaatgttatcggaaggttatccgattagtacgggaggcagaataagaaatagtgataaacaaattatctcatttggagtttctaaaacaaatgacaattcttttgaagccattacccaaaagcaagctgaagactttgattggtttagcacatatgatgaagctagaaagtatggtgaggttggagcaataaagaacgatgtccatgcagaaatagctgatggtgtactggcagcaaggaatatccctttaacagttaaagtaaaaaaaattggtagtatcaatgaaaaaggtacaccgaatatagctgttactgatgcggtaatttatcctacagcggataggaaaaaaggttatcgagttcgtgaaaatggtaagtataataactttactgagtatgatgaaaagggaaacataacgaaaattcaatctcctgtagggagtacagtaaactttgaaacacttggtattatgaacggtgaaacaagtagtgatgtgaaaactaataaaaatacttattatagttcagacaatgtaagtgtgacgattgataatttggcaaaactacccgattcaatggactctacctccttagatgaaaaagtggaaatgagagtgaaaataccaaaaggccttgattatgtggttggatcagctagatatggtgatcaatatattgagccgaaaattgaacagcaaggtgatgggagtaatcacctcgtttggtatgatacattgacacgtaataataagactctcaaaaaaattaattttgaggcacgtattaatccagtattacttcctcagggaaatcaagtaggactagagattcaaaatgtaatgagtagctctatggatactagattagagaagtttcggacaagctctaagaatatttctattgtgaaaattggtatggttggtgtaagtgaaaccataaagaaagtggctggaaaaaagaatagtgactatgagattgggatccagccatacaccacaataaaagatgaatcacatgtaaaggcacttacatatgtacctaggaataaggatggaaatggatctgcctttcatggtgtaacgttcttaaaacagttgacattagaaaatggtaatagtaagaacgttgaaatatggttgaataatagctttgttgaatcgaatgaccccaacaaggttaatttacaattaaatggttggtacaggtatacaggagagcaggacttatcaaaggtggtctctattttgctgtatataaatgattctttgagtagtagtgatgttgtgaaaatgaatcttgtattaggtacttacaataatgagtttgatgaccaatatgtaagtaaaacggttgttaacacttctgttgattataaattatcaccagtatctaatcaggtaaggtatacaatcgtagcagatgcaaatgtgggtttgcgaaaaattagaattgatactgcacctgctgagaatggacttccagtaaccgtaaggttagataaagatattgtatatgaagattctaataaagagaaactgaatattaatttatatgacaaggccgataataagcttgttgaaagtaaagtatatacaattgaggaactacctgaagagattaaattcaaagtagattctaagtttctaaagaaaaataataagagaaattatgaagtaagatttgaaaaagtaaataaagaatctattcttataatgaatggaaaagagaaagtagatacagacggttatacgtcttctgaggaaacaattaaggcgaatgctaaggaatctacggaactaaaatacaaaggtgttattatgactgagcgtgaggtcggaaaagaaatggaagttttttatgaaacacttacgattccgttaaaacggctgcctaagcaaaaaactggttacggttacgaattaaagacggaaattagttatcacaatgaattggcaattcctaatgatataaaggctggggctttagttgataagaagttaattgattcacatttaaattatgagaaaaaagaggataatatcattgttccactggaagaaacgaaaaaaaatgttacctcagataaaaagaatactgatgttacctttgaattgccacatataaatgtagagcaaaaaacgggtaatttatttacggatcaacaagtaaaagataaagattctcgtataaagaatgtgttaaaagatgggaagcgtaaattatatgccccaatttgggcggatttaggagagtataatctccttatacactctaatctgcctataggggctaataaggtgaattttgaggtaacgcaaccactacaattatatgcatacatgtatggtaccatggggtcaaaaacgttgaagaatgatgaattattaatagagcctgttgaccctaaaaatcctttctcaaatggtaaacctgctgggtggtctgatgaggatgttgcatggttaaagagagatgaaaaatcaaatcaatag

SEQ ID NO: 119 - DNA, 492 bp, unknown
  environmental sample
atggctattgacgtatacctgcaaatcgacggcatcaaaggcgaatccaccgacacctcccacaaggactggatcgaatgccgttccgtccagtgggaagtgctgcagccgaaatcggcaacggcatcgaccggcggcggccacacggccgagcgtaccgagcacaaggacatcgtgatcgccaaactggccgatctggcgaccccgctgctgctgcaaaattgctcgtcgggcaaaacgatcccgaaggccaagatcgaattcctgcgcgccgatggccagggcgagcgcatcaagtatttcgagatcgaactcgagaacgtcctgatcagcaatgtatcgccacgcgttgaagccggcgacatcctgtcggaaaacctgtcgctgaaatactcgaaggtgaagtggaagtacacccagcaaaaagtgggcggcggttcgggcggtaatacctcgggcggttgggatctgtcggccaacaaaacggcctga

SEQ ID NO: 120 - DNA, 492 bp, Janthinobacterium Sp.
atggcaatcgacgtttacttgcaaattgatggtatcaaaggcgaatccaccgacacctcccataaagattggatcgaatgcaagtcggtccagtgggaagtgctgcagccgaagtccgccaccgcctcgaccggcggcggccataccgccgaacgtaccgagcacaaggatatcgtggtcgccaagctggccgacctcgccacgcctctgctgctgcaaaattgctcatccggtaaaacgatcccgaaagccaagttcgaattcctgcgcgccgacggccagggcgagcgcatcaagtacttcgagatcgagctggaaaacgtgctgatcagcagcgtggcgccgtccgtcgccgctggcgacatcctcggcgagaacgtgtcgatcaagtattccaaggtcaagtggaaatacacgcagcaaaaagtcggtggtggctcgggcggcaatacctctggcggttgggatctgtcggccaacaagacgatttga

SEQ ID NO: 121 - DNA, 492 bp, Janthinobacterium Sp.
atggcaatcgacgtctacttgcaaattgatggcatcaaaggtgaatccaccgacaccggccacaaagattggatcgaatgcaagtcggtccagtgggaagtgttgcaacccaaatcggccaccgcgtcgaccggcggcggtcataccgccgagcgcaccgagcacaaggatattgtgatcgccaagctggccgacctggccacgcctttgctgttgcaaaactgctcctcgggcaaaaccattcctaaagccaagatcgaattcttgcgcgcggatggccagggcgagcgcatcaagtatttcgaaatcgaaatcgaaaacgtcctgatcagcagcgtatcgcccagggtcgtcgccggcgacatcctgaccgaagacctggcgctgaaatattccaaagtgaaatggaaatatacccagcaaaaagtgggcggcggttcgggcggcaatacttccggcggctgggatctgtcggcgaacaaaacagcgtaa

SEQ ID NO: 122 - DNA, 492 bp, Janthinobacterium Sp.
atggcaattgacgtctacctgcaaatcgatggcatcaaaggcgaatccaccgatgccacccacaaagattggatcgagtgcaaatcggtgcagtgggaagtgctgcaacctaagtcggccaccgcgtcgaccggcggcgggcataccgccgagcgcaccgaacacaaggacatcgtgatcgccaagctggccgatctggcaactccgctgctgctgcagaattgctcgtccggtaaaaccctgccaaaggcgaagatcgagttcctgcgcgccgacggccagggcgaacgcatcaagtatttcgaaatcgaactggaaaacgttctgatcagcagcgtcgcgcccgccgtgcacgccggcgacatcctcagcgaaaacctgtcgttgaaatactcgcaggtcaagtggaaatacacgcagcagaaagtgggcggcggctccggtggtaacacctccggcggttggaacctgtcgaccaataaaacggtctaa

SEQ ID NO: 123 - DNA, 492 bp, unknown
  Oxalobacteraceae
atggcaatcgacgtctatctgcaaatcgatggtatcaaaggcgaatccgccgatgctacccacaaggactggatcgaggtctcgaccgttcaatgggaagtgctgcagcctaagtcggctaccgcatcgaccggcggcggccacaccgccgaacgcaccgagcacaaagacatcgtggtctcgaagctggccgacctggctactcctctgctgctgcaaacctgctcgtcgggtaaaaccattcctaaagcgaagctggaattcctgcgcgcggacggtaatggcgagcgtatcaagtacttcgaaatcgaactggaaaatgttctgatcagcagcgttgcaccaaccgtcaagcagggcaacatcctgactgaagacgtggcgatcaagtattcgaaagtgaagtggaagtacacccaacagaaggttggcggcggttcgggcggtaacacctcgggtggctgggatctgtcggctaacaaaaccgcgtaa

SEQ ID NO: 124 - DNA, 492 bp, Collimonas Sp.
atggcaattgacgtttatctgcaaatcgacggcatcaagggcgagtcgaccgacagtgcgcacaaggactggatcgagtgcaaatcggtgcaatgggaagtgctgcagccaaagtcggcgactgcatccaccggcggcggccacacagccgagcgttgcgaacacaaggacatcgtcgtgaccaagatcgccgatctggctacgccgctgctgctgcagaactgctcatcgggtaagaccatcccgaaagccaagttcgaattcctgcgcgccgacggcaagggcgaccgcatcaagtatttcgaaatcgagctggtcaacctgctgatttccgacgtcacgccatcggtccaggaaggcgacgtgctgagcgaaagcatcagcctgaagtactcccaggtcaaatggaagtacacacagcaaaaaatcggcggcggttcgggcggcaatacttccggcggctgggatctgtcgaccaacaaggtcgtgtaa

SEQ ID NO: 125 - DNA, 492 bp, Collimonas Sp.
atggcaatcgacgtatatctgcaaattaacggcatcaagggcgaatcgaccgacagcgcgcataaagactggatcgaatgcaaatcggtgcaatgggaagtgctgcaaccgaagtcggctacagcatcgaccggcggcggccacacagctgaacgttgcgaacacaaggacatcgtgatcaccaagatcgccgatctggccacacctttgttgctgcaaaactgctcttccggcaaaaccatcgacagcgccaagtttgaattcctgcgtgctgacggcaagggcgaccgcatcaagtacttcgaaatcgagctctcgaacctgctcatctccgacgtcactccttcggtccaggaaggcgatgtcttgagcgaaagcgtcagcttgaagtactccaaggtcaaatggaagtacacccagcaaaaaatcggtggcggctccggtggcaacacatccggcggctgggatctgtcgaccaacaaggtcgtgtaa

SEQ ID NO: 126 - DNA, 492 bp, Collimonas Sp.
atggcaatcgacgtatatctgcaaattagcggcatcaaaggcgagtcgaccgacggcgcgcataaagactggatcgaatgcaaatcggtgcaatgggaagtgctgcaaccgaaatcggccacggcatcgaccggcggcggccacactgccgagcgttgcgagcacaaggatatcgtgatcaccaagatcgctgacctggcttcgccgctgctgctgcaaaactgctcttccggcaagaccatcgacagcgccaagttcgaattcctgcgcgccgacggcaaaggcgaccgcatcaagtattttgaaatcgagctgtccaacgtgctgatttccgacgtgaccccatccgtcgcagaaggcgatgttctcaacgagtccgtcagtctgaaatactccaaggtcaaatggaagtacacccagcaaaaaatcggtggcggctccggcggcaacacgtccggcggctgggatctgtcgaccaacaaggtcgtgtaa

SEQ ID NO: 127 - DNA, 492 bp, unknown
  environmental sample
atggcaatcgacgtatatctgcaaatcgacggcatcaaaggcgagtcgaccgaccagacccacaaagactggatcgaagtgaaatcggttgatttcggcgtgctgcagccaaaatcggccaccgcttccaccggcggcggccacacggccgagcgcaccgagcacaaggatgtgctgatctccaagctggccgacctggccacgccgatcctgctgcagacctgctcgcaaggtaaaaccattccgaaagcgaagctggaattcctgcgcgccgacggccagggcgaccgcgtcaagtacttcgagatcgaactggaaaacgtgctgatctcgagcgtggcgccaaccatccgtccaggcgacatcctgtcggaagacgtgtcgctgaagtactcgaaagtgaagtggaagtacacccagcagaaagtcacgggcggcaccggcggcaatacctcgggcggctgggacctgtcgactaaccgcattgcttaa

SEQ ID NO: 128 - DNA, 492 bp, Janthinobacterium Sp.
atggcaatcgacgtgtatctgcaaattgacggcatcaagggcgagtcgaccgacgacaagcacaaggactggatcgagtgcaaatcggtcagctggagcgtggagcagccgaaatcggccaccgcctcgaccggcggcggccacaccgccgaacgttgcgaacacaaggatatcgtgatttcgaaactggccgacctggcctcgccgatcttgctgcaaacctgttccgcgggcaaaaccatacccaaggcgcattttgaattcatgcgcgccgatggacaaggcgagcgcatcaagtattttgaaatcgaaatcgagaacgtgctgatcggcgcggtcacgccgaatgtgcacgaaggcgacatcctgaccgaacaggtcggcttcaaattttccaaggttaaatggaagtacacccagcaaaaagtgaccggcggcgccggcggcaatacctcgggcggctgggacctggcggccaacaaggtggtctga

SEQ ID NO: 129 - DNA, 2871 bp, Stenotrophomonas Sp.
atgaagcattcgaagttgagcctggccctggccgggctgatcgccgttggcgccatcgcggcggctgatgacgtcatggcaatgagttatcacgtgcagggggatcgcatcttcctgagcggcggggtgacctacgccgatgtggtgtcgttgcccgcgttgctggccaaggcacaggccgaggggcggccgatccgcgaagtggtgctgcgcacctccaatggtggcgcgctgatcgccggcgagtggctgcagggcgtgatccgcacgtccggcctgaacaccatcgtgtccggccactgcatttcgtcctgctcgatcatgcagtccggtggcgtcgaacgctatctggccggtgatctgccgatcgtcgattcggtacagatccacgcggccagcaacagcggcaaagtgatctacacgccgtcgccgcggatgacccagatctataccggcaactacggcggtggcatcgatgccgggctgctgcacaaggccatgtatgaagtcgtgcagcccaacggcctgctggtgttccgcgatccggcgcgcaccacgggtgcctcggtcactttcgatcctgatggcagcggcagcaagctggagtcgttcccggggcaggacatctacagcaacagggtcatcaccgccaagggctaccgcgatccgggcgatacgttgaatgtcaccgccaacgtgagcggcgacatcaacccgggctacctgcgcaccggtcgccagctgcagaccttcgtcgatgatgacttcgcgcgctggaacaccaactggcagtccagctacatcaacctggcgcagagcatctacaacgcgtccagcaatggtccgcagggcatcggcgcgaactcggtacaggactaccagaacgatcccacatacaaggccctgctgctgtccaagctgcgcctgggcgacctggatgcgtccacgctggacaactccatgggcgtgatccgcgtgaccagcggcgcgacatggcggacctccgcgaccaccggtgccgacttcatgctggtcgacaacggcaccatcgcactggaaggcggcgccctgcgcgcttcggaggtgcgggtaatgggcgcaggcatgctggtcggcaatggtgacgtggccggcaccgctatggatctcagtgcgctggccagcggtacccgcccgtcctggcgcgaggacggcttcaaccgcctgcgtgtgtacgggaccctgatgccgcgcggcggcgatctggtcacccatggctacgtcaacatcatgccgggcgggaaggtgctgttcgatgtgaccgagaacggcggggcgggcagtggccgcctgcgcgtaggcagtttcttcgacagcaagcagaccgacggcgcgctggtgatctccaaaggggccttcctcgaactgaacgtggcgcagggttactacggccaggacttccgccgtgacctggtgcagggcccgatataccagggcggcttcgaagaggtcgtgcgtctgggtgacaccggctacagcgccagcattaccggcggcgaagtgttccgcccgcgccacaactcgctgctgagtttcaacgtgaagcaggccgctgacggcctgtggctgaccgccaacccgggtttcgaccagctgggcctgttcaccaacggcacttccggcgatggcttgggccgcgcgctggcgaccgcttccgatcgcagggatggtggcctgaagtcgctgctcggcgccctgcagttcgccgaccgtgacgtgatcgcacagcaggccggtaccctgcgcggtgacgcgcacgcgaccctgcgcctggccgacaacgcattggtgggcagcatcggcgacgtggtgcagcaacaccaggccgcgatgcgcagtggtggtgatgccgacggcctggcttcgcaggccgcgcaatcggtgtcggcgcagccgggcatgcgccacggcagcctgttcaaccagctggccatgcatctggtcgagccggcggcgggtggcggtgaaggcagtggctctggtcgcaaccatggcctgtgggcgcgcggtttcgccagccacggccgcatcgatgccgacggtggcgtggcaggcttgagccataacatcggcggcatcgtcgtcggcgccgatacccgcgttgccgatgaccgcgtcaccctgggcgtcagcgtggcagcggcggatatgtcgaccaagggccgcgacggctccgacttcagtggtgacgtgcgcgcgctggacgtgggcggctacctggacgcgacctattcgcgcggctatctgtcggcggcggtgcgctacacagacctgcgtcacgacacccgccgcagcgtcagcggtatcgatggcctgcagcagccgctgcgtgccaagtacagcaacgatgcgatctccgcgcgggtggagcacgcgttctcattcaccacgggcaagggcctggtgatccagccgctgttgccggtggtggactacgcgcgtacctcggccacgcgcttcaatgaagggcagggtgcgggtgcactggtcggtcgcagcggcagcctggagagcatccgcgtgggcgccggcctgcagctgttcaggaccttcgaaggcaacaacggcgagcgcattaccccgcgtgcccgcgtggtctggcagaaggaactgggcgactcgcaggcgcgctacagcaccggcttcgccgccgctccggatctggtgttcggggcaagcagccaggccgtgggcgagcaggtgctggcctggaacctgggcgtgaccagccgcgccagcgaacgcctgtcgatcatggccgactacgtgggcgagcgtcgtgacgggcagatccagaacggcgtgatgctggggctgggttacaagttctga

SEQ ID NO: 130 - DNA, 2871 bp, Stenotrophomonas Sp.
atgaagcattcgaagttgagcctggccctggccgggctgatcggcgttggcgccatcgcggcggctgatgacgtcatggcaatgagttatcacgtgcagggggatcgcatcttcctgagcggcggggtgacctacgccgacgtggtatcgctgccagcgttgctggccaaggcgcaggccgagggccggccgatccgcgaagtggtgctgcgcacctccaatggcggcgcgttgatcgccggcgagtggctgcagggcatcatccgcacatccggcctgaacaccatcgtgtccggccactgcatttcgtcctgctcgatcatgcagtccggtggcgtcgaacgctatctggccggtgatctgccaatcgtcgattcggtacagatccatgcggccagcaacagtggcaaggtgatctacacgccgtcgccacggatgacccagatctacaccggcaactacggcggcggcatggacgccgggctgctgcacaaggccatgtatgaagtcgtgcaacccaacggcttgctggtattccgagatccggcgcgcaccacgggtacctcggtcaccttcgaccctgatggcagcggcagcaagctggagtcgttcccgggccaggacatctacaacaacaggatcatcactgcgaagggttaccgcgatccgggcgatacgttgagtgttaccgccaacgtgagcggcgacatcaacccgggttacctgcgcaccggtcgccagctgcagaccttcgtcgatgatgatttcgcgcggtggaacaccaactggcagtccagctacatcaacctggcgcaaagcatctacaacgcgtccagcaatggtccgcagggcatcggcgcgaactcggtacaggactaccagaaagatccgtactacaaggccctgctgctgtcgaagctgcgcctgggcgacctggacgtgtccacgctggacgactcgatgggcgtgatccgcgtgaccaacggtgccacctggcgaacctccgcgaccaccggtgccgacttcatgctggtcgacaacggcaccatcgcgctggaaggcggcgccctgcgcgcttcggaggtgcgggtgatgggcgcaggcatgctggtcggcaatggtgatgtggcgggcaccgcgatggatctcagtgcgctggccagcggcacccgcccgtcctggcgcgaggatggcttcaaccgcctgcgcgtctacggcacgctgatgccgcgcggtggcgacctggtcacccatggctacgtcaacatcatgccgggcggcaaggtgctgttcgacgtgaccgagaacggcggcgccggcagtggccgcctgcgcgtaggcagtttcttcgacagcaagcagaccgacggcgcgctggtgatctccaagggtgccttccttgaactgaacgtggcgcagggctactacggccaggatttccgtcgcgatctcgtgcagggcccgatctaccagggcggcttcgaagacgtcgtgcgcctgggcgacaccggctacagcgccaacatcaccggcggcgaagtgttccgcccacgccacaactcgctgctgagcttcaacgtgaaacagaccgcggacggcctgtggttgaccgccaacccgggcttcgaccagctggggctgtttgccaatgctgtttcgggcgatgcccttggccgtgcgctggcgaccgcttccgatcgcaaggatggtggcctgaagtcgctgctcggcgccttgcagttcgccgaccgtgatgtgatcgcacagcaggccggtgccctgcgcggtgacgcgcacgcgagcctgcgcctggccgacaatgcattggtgggcagcattggcaacgtggtgcagcagcaccaggcggcgatgcgcagtggcggcgatgccgacggcctggcctcgcaggccgcgcagtcggtctcggcgcagccgggcatgcgccacggcagcctgttcaaccagctggccatgcatctggtcgagccggcggcgggtggcggtgaaggcagtggctctggtcgcaaccatggcctgtgggcgcgaggtttcgccagccacggccgcatcgatgccgacggtggcgtggccggcttgagccataacatcggcggcgtcgtcgtcggtgccgatacccgcgttgccgatgaccgcgtcaccctgggcgtcagcgtggcagcggcagatatgtcgaccaagggccgcgatggttccgacttcagcggtgacgtgcgcgcgctggacgtgggcggctatctggacgcgacctattcgcgcggctatctgtcggcggcggtgcgctataccgacctgcgtcatgacacccggcgcagcgtgagcggcatcgacggcctgcagcagccgctgcgcgccaagtacaacaacgatgcgatctcggcacgggtggaacacgcgttctcgttcaccactggcaagggcctggtgatccagccgttgttgccggtggtggactacgcgcggacctcggccacccgcttcaatgaagggcagggcgcgggtgcgctggtgggtcgcagcggcagcctggagagcatccgcgtgggtgcgggcctgcagctgttcaggaccttcgagggcgacaacggcgagcgcatcaccccgcgtgcgcgcgtggtctggcagaaggagctgggcgattcgcaggcccgctacagcaccggcttcgccgcagcaccggacctggtgttcggcgccagcagccaggccgtgggcgagcaggtactggcctggaacctgggcgtgaccagccgcgccagcgaacgcctgtcgatcatggccgattacgtgggcgagcgtcgtgacgggcagatccagaacggcgtgatgctgggcctgggctaccggttctaa

SEQ ID NO: 131 - DNA, 2874 bp, Stenotrophomonas Sp.
atgaagcattcgaagttgagcctggccctggccgggctgatcggcgttggtgccaccgcggcggttgatgacgtcatggcaatgaattatcacgtgcagggcgatcgcatcttcctcagtggcggcgtcacctatgccgacgtcgtgtcgctgccggcgttgctggccaaggcgcaggccgagggccggccgatccgtgaggtggtgctgcgcacgtccaatggtggcgcgttgatcgccggcgagtggctgcagggcatcatccgtacctccggactgaacaccatcgtgtccggcaattgcatttcatcctgctcgatcatgcagtctggtggcgtcgagcgctatctggccggcgaccttccgatcatcgactcggtgcagatccacgcggccagcaacggcggcaaggtgatctacacgccgtcgccgcgcatgacccagatctataccggcaactacggtggtggcatggatgccggcctgctgcacaaggccatgtacgaggtggtgcagccgaacggcctgctggtgttccgcgatccggctcgcggcacgggcccctcggtcaccttcgatcccgatggcagcggcagcaagctggagtcgttccccggccaggacatctacagcaacaggatcatcaccgcgagcgggtaccgcgatccgggcgatacgttgaatgtgagcgcgaacgtgagcggcgacatcaatcccggctatctgcgcaccggtcgccagctgcagaccttcgtcgatgacgatttcgcgcgctggaacaccaattggcagtccagctacatcaacctggcgcagagtatctacaacgcctccagcaatggtccgcagggaatcggcgcgaactcggtacaggactaccagaacgatcccacctacaaggccctgctgctgtccaagctgcgcctgggtgacctggatgtgtccacgctggacaacgccatgggcgtgatccgcgtgaccaatggcgccacctggcggacctccgcgaccaccggtgccgacttcatgctggtcgacaacggcaccatcgccctggagggcggcgccctgcgtgcttcggaagtacgcgtgatgagcgccggcatgctggttggccacggtgacgtggcagggaccgcgatggatctcagtgcactggccagcggcacgcgaccgtcctggcgcgaggatggcttcaaccgcctgcgtgtctacggcacgctgatgccgcgcggtggcgatctggtcacccacggctacgtcaacatcatgccgggcggcaaggtgttgttcgacgtcaccgaaaacggtggcaccggtggtggccgcatccgcgtgggcagcttcttcgacagcaggcagaccgatggggcgctggtgatctccaagggcgccttcctcgaactgaacgtggcgcagggctactacggccaggattttcgtcgcgatctcgtgcagggcccgatctaccagggcgggttcgaagaggccgtgcgcctgggcgataccggctaccgcgccagcatcaccggcggtgaggtgttccggccgcgccacaactcgctgctgagcttcaacgtgaagcagaccgccgatggcctgtggctgaccgccaaccccggtttcgatcagctgggcctgttcgccaacggcacctcgggtgatggcctgggccgcgcgctggccacggcttccgaccgtcaggacagcagcctgaagtcgctgctgggcgcgctgcagttcgccgaccgtgatgtgatcgcgcagcaggccggtaccctgcgcggtgacgcgcacgcgagcctgcgcctggccgacaacgcgctggtgggcagcatcggcaacgtggtgcagcagcaccagacggcgacgcgcagcggcggtgatgccgacggcctggcctcgcaggtggcgcagtcggtctcctcccagccgggcatgcgccatggcagcctgttcaaccagctggcgatgcacctggtcgagccggcatcgggcagcgctgcgggcagcggtgatgcgggacgcagccacggcatctgggcgcgcggtttcgccagccatggccgcatcgatgccgatggcggcgtcgctggcctgagccacaacatcggtggcatcgtgatcggtgcagacacccgcgtggccgatgaccgcgtcaccctgggcgtcagcgtggcggcggccgatatgtcgaccaagggcagcgacggctccgacttcagcggtgacgtgcgcgcactggacgtgggtggctatctggacgcgacctattcgcggggctacctgtcggcagccgtgcgctacaccgacctgcggcatgacacccgccgcagtgtcagcggcatcgacggcctgcagcagccgcttcgcgccaagtacagcaacgatgcgatctccgcacgagtggagcatgcgttctccttcacgaccgggaagggcctggtgatccagccgttgctgccggtggtggactacgcgcgtacctcggccacccgcttcaacgaagggcagggcgctggcgcgctggtgggacgcagtggcagcctggagagcatccgcgtaggtgccggcctgcagctgttcaagaccttcgagggcaacaacggcgagcgcatcaccccgcgtgcccgcgtggtctggcagaaggagctgggcgattcgcaggcgcgctacagcaccggctttgccgcagccccggacctggtgtttggtgccagcagccaggccgtgggcgagcaggtgctggcctggaacctgggtgtgaccagtcgcgccagcgagcgtctgtcgatcatggccgactacgtgggtgagcgccgcgacgggcagatccagaacggcgtgatgctcggcttgggctacaggttctga

SEQ ID NO: 132 - DNA, 2874 bp, Stenotrophomonas Sp.
atgaagcattcgaagttgagcctggccctggccgggctgatcggcgtcggcgccctcgcggctgctgatgacgtcatggcaatgagttatcacctgcagggcgatcgcatcttcctcagtggcggggtgacctacgccgacgtggtgtcgttgccggcattgctggccaaggcacaggccgagggccggccgatccgcgaagtggtgctccgcacctccaacggcggcgcgctgatcgccggcgagtggctgcagggcgtgatccgcaccgccggcctgaacaccatcgtgtccggccactgcatctcgtcgtgctcgatcatgcagtccggtggcgtccagcgctatctggccggcgacctgccgatcgtcgattcggtgcagatccacgcggccagcagcggcggcaaggtgatctatacgccgtcgccgcgcatgacccagatctacaccggcaactacggcggcggcatggatgcgggcctgctgcacaaggccatgtacgaggtcgtgcagcccaatggcctgctggtgttccgcgacccggcgcgcaccaccggcgcctcggtcaccttcgacccggatggcagcggcagcaagctggagtcgttcccgggccaggacatccatagcaacaacatcatcaccgcgaacggctatcgcgatcctggcgacacgttgaacgtgagcgcgaacgtgagcggcgacatcaaccccggttacctgcgcaccgggcgccagctgcagactttcgtcgacgacgatttcgcgcgctggaacaccaactggcagtccagctacatcaacctggcgcagagcatctacaacgcttcaagccgtggcccgcagggcatcggcccggattcggtgcaggactacctcaacgatccgggcatccaggcgctgctgctgtccaagctgcgcctggccgacctggacgtgtccacgctcgacaacgccatgggcgtgatccgcgtgagcaacggtgccacctggcgcaccgccgccaccaccggcgccgacttcatgctggtcgacaacggcaccatcgcactggaaggcggcgcgctgcgtgcgtcggaggtgcgcgtgctgggcgcgggcatgctggtcggccatggcgacgtggccggcactgcgatggatcttgatgcactgggcagcggttccggcccctcctggcgcgaggacggcttcaaccgcctgcgcgtgtttggcacgctgatgccgcgcggcggtgacctggtcacccacggctacgtcaacatcatgccgggcggcaagctgctgttcgacgtcaccgagaacggcggcgcggccacgggccgactgcgcgtgggcacgttcttcgatgacgaaccgaccgacggcgcgctggtgatctccaagggcgccttcctcgaattgaatgtggcgcaaggctactacggccaggatttccgccgtgacctggtgcagggcccgatctaccagggcggcttcgaggatgtcgtgcgcctgggcgacaccggctacagcgccagcatcaccgcgggcgatgtgttccgcccgcgccacaactcgctgctgagcttcaacgtgaagcagaccgccgacggcctgtggctgaccgcaaacccaggcttcgatcagctgggcctgttcgccaacgctacctccggcgacgggctgggccgcgcgctggcgaccgcctccgcccgccaggacggcaacctgaagtcactgctgggcgcgctgcagttcgccgaccgtgatgtgatcgcgcagcaggccggtgccctgcgcggtgatgcgcatgccagcctgcggctggccgacaacgcgctggtcggcagcatcggcaacgtggtgcagcagcaccaggccgcgatgcgcagtggtggcgatgccgatggcctggcttcgcaggcggcgcagtcggtgtcggcccagccgggcatgcgccacggcagcctgttcaatcagctggcgatgcatctggtcgagccggcgtccggcagtgctgcgggcggcggtgatgctggccgaaaccgtggcatatgggcgcgcggcttcgccagccatggccgcatcgatgcggagggcggcgtggccggcctcagccacaacatcggtggcatcgtggtcggtgccgatacccgcgtggccgatgaccgcgtcaccctcggcgtcagcgtggcggccgctgacatgtcgaccaagggccgcgacggctccgacttcagcggtgacgtgcgtgcgctggatgtgggcggctacctggatgcgacctattcgcgcggctacctgtcggcggcggtgcgctacaccgacctgcgccacgacacccgtcgcagcatcagtggcatcgatggtctgcagcagccgctgcgcgccaagtacaacaacgatgcaatctccgcgcgggtcgagcacgcgttctcgttcaccaccgtcacggggctggtgatccagccgttgctgccagtggtggactacgcgcgcacctcggccacgcgcttcaatgaagggcagggcgcgggtgcactggttggccgcagcggcagcctggagagcatccgcgtcggcgccggcctgcagctgttcaagaccttcgaaggcaacaacggcgagcgcatcaccccgcgcgcccgcgtggtctggcagaaggaactgggcgattcgcaggcccgctacagcaccggattcgccgccgccccggacctggtgttcggcgccagcagccaggccgtgggtgagcaggtactggcctggaacctgggcgtgaccagccgcgccagcgaacgcctgtcgatcatggccgactacgtgggcgagcgccgcgacgggcagatccagaacggcgtgatgcttggcttgggctaccggttctaa

SEQ ID NO: 133 - DNA, 2874 bp, unknown
  environmental sample
atgaagtattcgaagttgagcctggccctggccgggctgatgggtgtcgccaccatgtccgtggctgatgacgtcatggcaatgaattatcacgtgctgggcgatcgcatcttcctgagtggcgatgtgacctacgccgacgtggtgtccctgccggcactgctggccaaagcgcaggccgaaggccggccgatccgcgaagtggtattgcgcacctccaatggtggcgcgttgatcgccggcgagtggctgcagggagtgatccgcacctccggcctcaacaccatcgtgtccggcaactgcatttcatcctgctcgatcatgcagtccggtggtgtcgagcgctatctggccggcgacctgccgatcatcgactcggtgcagatccacgcggccagcagcggtggcaaggtgatctacacgccgtcgccgcgcatgacccagatctacaccggcaactatggcggcggcatggatgccggcctgctgcacaaggccatgtatgaagtggtacagccgaacgggctgctggtgttccgcgatccagcccgcagcacgggggcctccatcacctttgatccggatggcagcggcagcaagctggaatcattcccgggccaggacatctacagcaacaggatcatcaccgccaacgggtaccgcgatccgggcgacacgttgaatgtgagcgcgaacgtgagcggcgatatcaatccaggctacctgcgtaccggacgccagctgcaagccttcgtcgatgatgatttcgcgcgctggaataccgactggcaatccacctacatcaaccttgcgcagagcatctacaacgcctcgagccgcggcccgcagggcatcggcccgctgtcggtgcagggttacctgaatgacccggatatccaggacctgctgctgtccaaactgcgtctggcggatctggatgcctctacgctggacaacgccatcggtgtgatccgcgtgaccaatggcgccacctggcgcacgtccgctaccacgggtgcggacttcatgctggtggacaacggcaccatcgccctggaaggcggtgccctgcgcgcctcggaagtgcgcgtgctcggggctggcatgctggttggccacggcgacgttgccggcacggcgatggatctcaatgcactgggcgaaggcactggcccttcctaccgtgaagacggcttcaatcgcctgcgcgtgttcggcacactgatgccgcgcggtggtgatctggtcacccatggttacgtcaatatcatgccgggcggcaaggtgctgttcgatgtgaccgagggcggcggcacggcaacaggccgcctgcgcgtgggcaccttcttcgatgacgaacagaccgacggcgcgctggtgatctccaagggcgccttcctcgaactgaacgtggcacagggctactacggccaggacttccgtcgcgatctggtggaaggaccgatctaccaaggtggtttcgaagaagccgtgcgcttgggggataccggctacagtgccagcatcactggtggtgatgtgttccgcccgcggcacaactcgctgttgagcttcaatgtgaagcagaccgccgatggtctgtggttgaccgccaaccccggcttcgaccaggtggggctgttcgccaacggcacttcgggcgatggcctgggccgcgcattggcaaccgcctccgatcgccaggacaaaggcctgaagtcgctgctcggtgcactgcagttcgccgatcgcgacgtaatcgcacagcaggccggagccctgcgcggtgatgcgcacgccagcctgcgcctggccgacactgcgctggtgggcagcatcggcaacgtcgtgcagcagcaccaggccgcgatgcgcagcggcggggacgccgacggcctggcttcgcaggccgcgcagtcggtctcatctcaaccgggcatgcgccatggcagcctgttcaaccagctcgccatgcatctggtcgagccggcgtcgggcagcgctgcgggcagcggtgatgctggacgcaaccatggcatctgggcccgcggtttcgccagccatggccgcatcgatgccgacggtggcgtggcggggctcagccacaacatcggcggcatcgtgatcggtgccgacacccgcgtggccgatgaccgcgttaccctcggcgtcagcgtggcagcggccgacatgtcgacaaaggccagtgacggctccgggttcaccggcgatgtgcgcgcgctggacgtgggcggctacctggatgcgacctactcgcggggctacctgtcggcagcggtgcgctacaccgacctgcgccacgatacccgccgcagcatcggcggtatcgatggcctgcagcagccacttcgcgccaggtacagcaacgatgcgatctccgcacgggtagagcacgcgttctccttcaccaccggcaagggactggtgatccagccgttgctgccggtggtggactacgcgcgtacctcggccacccgcttcaatgaaggccagggcgcgggtgccttggtagggcgcagcggcagcctggagagcatccgcgtgggcgcaggcctgcagctgttcaagaccttcgagggcaacaacggcgagcgcatcacgccgcgcgcccgcgtggtctggcagaaggaactgggcgactcgcaggcccgttacagcaccggtttcgccgctgcaccggatctggtgttcggtgccagcagccaggccgtgggcgagcaggtgctggcctggaacctgggtgtgaccagccgggccagcgagcctctctcgatcatggccgattatgtaggcgagcgccgcgacgggcagatccagcatggcgtgatgctggggctgggctacaagttctaa

SEQ ID NO: 134 - DNA, 2871 bp, Stenotrophomonas Sp.
atgaagtattcgaagttgagcctggccctggccgggctgatgggcgttgccgccatatccgtggtggatgacgtcatggcaatgaattatcacgtgcagggcgatcgcatcttcctgagtggcgatgtgacctacgccgacgtggtgtccctgccggcactgctggccaaggcgcaggccgaaggccggccggtccgtgaggtggtgctgcgcacgtccaatggtggtgcgttgatcgccggcgagtggctgcagggcatcatccgcacctccggactgaacaccatcgtgtccggcaattgcatctcgtcctgctcgatcatgcagtctggtggcgtcgaacgctatctggccggcgatctgccgctcatcgactcggtgcagatccacgccgccagcagcggcggcaaggtgatctacacgccgtcgccgcgcatgacccagatctataccggcaactacggtggtggcatggatgccgggctgctgcacaaggccatgtacgaagtggtgaagccgaatggcctgctggtgttccgcgatccggcacgcagcaccggttcctcggtcactttcgaccccgatggcagtggcagcaagctggagtcgttccccggccaggatatctacagcaacaggatcatcaccgcgagcgggtaccgcgatccgggcgacaccttgaatgtcaccgccaacgtgaccggcgacatcaaccccggctacctgcgtaccggacgccagttgcaggcgttcgtcgatgatgatttcgcgcgctggaataccgactggcgatccacctacatcaatctcgcgcagagcatctacaacgcatccagcaagggtccgcagggcatcggtgcgctgtcggtgcagggttacctcagtgacccggacatccaggacctgttgctgtccaagctgcggctggctgatctggatgtctccacgctggacaacgccatgggcgtgatccgggtgaccaacggcgccacctggcgcacgtccgcgacgacgggtgcggatttcatgctggtcgacaatggcaccatcgcgctggaaggcggtgccctgcgcgcatcggaagtgcgcgtgctcggcgcaggcatgctggtcggccatggcgatgtggcgggtacggcgatggaccgcgctgcattgctggacggcaccggcccgtcgtaccgcgaagacggtttcaaccgcctgcgcgtgttcggcacgctgatgccgcgcggtggcgatctggtcacccatggctacgtcaacatcatgccgggcggcaaggtgctgttcgacgttacagagaatggcggcaccgctgcaggccgcctgcgcgtgggcaccttcttcgatgacgagcagaccgagggggcactggtgatctccaagggtgccttcctcgaactgaacgtggcgcagggctactacggtcaggacttccgtcgtgacctgattgagggcccgatctaccagggcggcttcgaagaggccgtgcgcctgggtgacaccggctacagtgccagcatcagcggtgatgtgttccgtccccgccacaattcgctgttgagcttcaacgtgaagcagaccgccgatggcctgtggctgaccgccaaccccggctttgaccagctgggcctgttcgccaacggtacgtccggcgacggcctgggccgtgcgctggcgactgcttccgatcgccaggacaagggactgagatcgctgctgggcgcactgcagttcgccgaccgcgatgtgatcgcacaacaggccggtgccctgcgcggtgatgcgcacgccagcctgcgcctggccgacaccgcgctggtgggcagcatcggcaacgtcgtgcagcagcaccagtcggccatgcgcagcggcggcgatgccgatggcctggcctcgcaggtggcgcagtcggtctcctcccagccgggcatgcgccatggcagcctgttcaaccagctggcgatgcacctggtcgagccggcgccgggcagcgttgcgggtagcggtgatgccggacgtagccatggcatctgggcacgtggtttcgccagccatggccgcatcgatgccgacggtggcgtggccggcctgagccacaccattggtggcatcgtgatcggtgcagacacccgcgtggccgatgaccgcgtgaccctgggtgtcagcgtggcggcggcggacatgtcgaccaaggccagcgatggctctggtttcaccggagatgtgcgcgcgctggacgtgggcggctacctcgatgcgacgtacgcgcgcggctatctgtcggcagcggtgcgctacaccgatctgcggcatgacacccgtcgcagcatcggtggtatcgatggcctgcagcagccgctgcgcgccaagtacagcaacgatgcgatctccgcgcgtgttgaacatgcgttctcgttcaccaccggcaagggcctggtgatccagccgttgctgccggtggtggactacgcgcgtacttcggccacccgcttcaacgaagggcagggcgctggtgcgctggttggccgcagtggcagcctggagagcatccgcgtgggtgcgggcctgcagctgttcaagacctttgagggcaacaacggtgagcgcatcacgccgcgcgcccgggtggtctggcagaaggagctgggcgattcgcaggcccgctacagcaccggcttcgccgcggcaccggatctggtgttcggcgccagcagccaggcggtgggcgagcaggtgctggcctggaacgtcggcgtgaccagtcgcgccagcgagcgcctgtcgatcatggccgactacgtgggtgagcgccgcgacgggcagatccagaacggcgtgatgctgggcctgggctaccggttctaa

SEQ ID NO: 135 - DNA, 2874 bp, Stenotrophomonas Sp.
atgaaacattcgaagttgagcctggccctggccgggctgatgggcgtcaccgccatggcggcggttgatgacgtcatggcaatgaattatcacgtgcgggacgatcgcgtcttcctcagcggcggcgtcaccgttgctgacgtggtggcgctgcccgcgctgctggccaaggcacaggctgaaggccgtccgatccgcgaagtcgtgctgcgcacatccaatggtggcgcgctgatcgccggcgagtggctgcaggcggtgatccgcacccagggcctggacaccatcgtgtccggccactgcatctcgtcctgctcgatcatgcagtccggtggcgtcaaccgttacctcggcggcgatctgccactggtcgactcggtgcagatccacgccgccagcagtggcggcaagatcacctatgcgccgtcagcgcgcatgacccagatctacacaggcaactacggcggcgggatggatgcgggcctgttgcacaaggcgatgtatgaagtggttcaacccaatggcctgctggtattccgcgacccggcgcgcaccacgggtacgtcggtcaccttcgatccggatggcagcggcagcaagctggagtcgttcccgggccaggacatccgcggcaacaacatcatcaacacggcaggctatcgcgatccgggcgacaccctccgtgtcaccagcaacgtcagcggcgacatcaacccgggctacctgcgcaccgcgcgccagctgcaggccttcgtcgacgacgatttcgcgcgctggaacaccgactgggccagcacctacatcaacgatgcggtgagcctgtacaacgtctccacgcggggggcgaacggtatcggcgcgcagtcgttgcagcagctgctcgccgatcccgacgtccagaatgaactgcgcggccagctgcggctggccgatctggatgcctcaaccctggccagttcggcgggcgtgatccgtgtcagcaatggcgctacctggcgcaccgccgcaaccactggcgccgatttcattctggtggacaacggcaccatcgcactggagggtggtgcgctgcgcacccccgagctgcgcgtgatgccgggcagcatcgtggtcggccacggtgatatcgcatcggtcggcaccgacagcgatgcgctgctggatggcaccggcccgtcctaccgcgaagacggcttcaaccgcctgcgcgtgttcggcacgttgatgccgcgtggtggcgatctggtgacccacggctacgtcaacatcatgcccggcgggcaggtgctgttcgatgttaccgaaaccggtggtaccggcagtggccgcctgcgcgtcggcagcttctacgatggcggctccgaggagggcgcgctggtgatcgcgcagggcgcacatctggcgctgaacgtggcccagggcttctatgccggcacctaccgtcgcgacctggtggaaggaccgatctaccaggggggcttccaggatgccgtgcggctgggcgatgccggctacagcgccagcgtcacggccggtgaagtgttccgcccgcgccacaattcgctgctcagcttcaacgtcaaccagaccgccgacggcctgtggctgaccgccaacccgggcttcgatcagctgggactgttcgccaacggcacctccggcgacggcctggggcgcgcgctggccgctgcatcggaccgccaggacagcggcctgaagtcgttgctcggcgcgctgcagttcgctgaccgtgatgtgatcgcacagcaggctggcgccctgcgcggtgacgcgcatgccagcctgcgcctggccgacaatgcactgatcggcagcatcggcaacgtggtgcagcagcaccaggcagcgatgcgcagtggcggcgatgcagacgggttggcttcgcaggcggcgcagtcggtgtcggcgcagccgggcatgcgccatggcagcctgttcaaccagctggccatgcatctggttgaaccggccggcgaagctgctggcgacagcggcgtggcggggcgcagccatggcctgtgggcgcgcggtttcgccagccatggccgcatcgacgccgacggtggtgtggccggcctgagccacactgtcggcggcatcgtgatcggtgccgatacccgcgtggccgatgaccgcgtgaccctcggcgtgagcgtggccgccgccgacatgtcgaccaaggccagcgacggctccggcttcagtggcgacgtacgcgcgctggatgtgggcggctacctggatgcgacctattcgcggggctacctgtcggcggccgtgcgctacaccgacctgcggcatgacacccgccgcagtgtcagcggcattgatgggctgcagcagcctctgcgcgcgaagtacagcaacgatgccatctcggcacgggtggagcatgcgttctccttcaccactggaaagggtctggtgatccagccgctgctgccggtggtggactacgcacggacctcggccacccgtttcaatgaagggcagggcgccggtgcgctggtgggccgcagcggcagcctggagagcattcgtgtgggtgccggcctgcagctgttcaagaccttcgaaggcaacaacggtgagcgcatcaccccgcgtgcccgcgtggtctggcagaaggagctgggcgattcgcaggcgcgctacagcaccggctttgctgcggccccggacctggtgtttggtgccagcagccaggccgtgggcgagcaggtgctggcctggaacgtcggcgtgaccagtcgcgccagcgaccgcctgtcgatcatggccgactacgtgggtgagcgccgcgacgggcagatccagaacggcgtgatgctgggcctgggctaccggttctaa

SEQ ID NO: 136 - DNA, 2874 bp, Stenotrophomonas Sp.
atgaagcactcgaagttgagcttggcccttgcgggcctgatcggcatcaccgccatcacggcggttgatgacgtcatggcaatgaattatcacgtgcaggacgaccgcgtcttcctcagcggcggggtcaccgtcgccgacgtggtggcgctgcccgcgctgctggccaaggcgcaggccgaagggcgcccgatccgcgaggtcgtgctgcgcacatccaatggcggcgcgctgatcgccggcgagtggctgcaggccgtgatccgcacccaggggctggataccatcgtgtccggccactgcatttcgtcctgctcgatcatgcagtccggcggcgtcaaccgttacctcggtggcgatctgccgctggtcgattcggtgcagatccatgctgccagcagcggtggcaggatcacctacgcaccgtctgcgcgcatgacccagatctacaccggcaactacggtggcggcatggatgcgggcctgctgcacaaggccatgtatgaggtggtgcagcccaatggcctgctggtgttccgcgacccggcgcgcaccacgggtacctcggtcaccttcgatccggatggcagcggcagcaagctgcagtcgttcccgggccaggacatccgcagcaacaccatcatcaacaccgtgggctaccgcgatccgggcgacaccctgcgtgtcaccagcaacgtcagtggtgacatcaacccgggctacctgcgcaccgcgcgccagctgcaggccttcgtcgacgacgatttcgcgcgctggaacaccgattgggccagtacctacatcaactatgcggtgagcctgtacaacgtctccacgcgcggtccgaacggcatcggtgcacagtcgctgcagcagctgcttgccgatcccgacctccaggacgcgttgcgcggacagctgcggctggctgatctggatgcctcgaccctggccagttccgccggcgtgatccgtgtcagcaatggcgccacctggcgcactgcggaaaccaccggcgctgatttcatgctggtcgacaacggcaccctcgcactggagggcggcgcactgcgcactcccgagctgcgggtgatgccgggcagcatcgtggtcggccatggtgacatcgcatcggtgggcgtggacaccgacgcgctgctggacggcaccggcccgtcctaccgcgaagacggcttcaaccgtctgcgcgtgttcggcacgctgatgccgcgcggtggcgatctggtgacccacggctacgtcaacatcatgcccggcggccaggtgctgttcgatgttaccgaggccgggggcaccggcagtggccgcctgcgcgtcggcagcttccatgatggcggtgccgaagcgggggcgctggtgatcgcacagggcgcacacctggccttgaacgtcgcccagggcttctatcccggtgcctaccgccgcgacctggtggaggggccgatctaccagggtggtttccaggatgtcgtgaggctcggcgatgccggctacagcgccagcatcactgcgggcgacgtgttccgcccgcgccacaattcgctgctcagcttcaacgtcaaccagacggccgatggcctgtggctgaccgccaacccgggcttcgatcagctgggcctgttcgccaatggcacttccggcgacggcctggggcacgcgctggcagccgcatcggaccgccaggacagcggcctgaagtcgttgctcggcgcgcttcagttcaccgaccgcgatgtgatcgcacagcaggctggcgccctgcgcggtgatgcacatgccagcctgcgcctggccgacaacgcactgctgggcagcatcggcaacgtggtgcagcagcaccaggcggcgatgcgcagtggcggcgacgccgatggcctggcctcgcaggcggcgcagtcggtctcggcgcagccgggcatgcgccatggcagcctgttcaaccagttggccatgcatctggtcgagccagcgggcgaggctgctggcgacagcggcgtagcgggtcgcagccgtggcctgtgggcgcgcggtttcgccagccatggccgcatcgacgccgagggtggcgtggcaggcctgagccataccgtcggcggcatcgtggtcggtgccgacacccgcgtggccgatgaccgcgtgaccctgggtgtcagcgtggccgcggccgacatgtcaaccaaggccagcgatggctccggtttcagtggcgacgtgcgtgcgctggatgtgggcggctacctggatgcgacctattcgcgtggctacctgtcggcggccgtgcgctacaccgacctgcgccacgatacccgccgcagcctgtcggccatcgagggcctgcagcaaccgttgcacgcccgatacagcagcgatgcggtctcggcgcgggtcgaacacgcgttctctttcaccaccggcaagggggtggtgatccagccgctgctgccggtggtggactacgcgcggacctcggccacccgcttcaacgaagggcagggcaccggtgcgctggtggggcgcagcggcagcctggagagcatccgcgtgggcgccggcctgcaggtgttcaggaccttcgagggcaacaacggcgagcgcatcaccccgcgtgcccgcgtggtctggcagaaggagctgggcgattcgcaggcgcgctacagcaccggctttgctgcggccccggacctggtgtttggtgccagcagccaggccgtgggcgagcaggtgctggcctggaacctgggcgtgaccagtcgtgccagcgagcgcctgtcgatcatggccgactacgtgggtgagcgccgcgacgggcagatccagaacggcgtgatgctgggcctgggctacaggttctaa

SEQ ID NO: 137 - DNA, 2874 bp, Stenotrophomonas Sp.
atgaagcactcgaagttgagcctggcccttgcgggcctgatcggcatcaccgccatcacggcggttgatgacgtcatggcaatgaattatcacgtgcaggacgaccgcgtcttcctcagcggcggggtcaccgtcgccgacgtggtggcgctgcccgcgctgctggccaaggcgcaggccgaagggcgcccgatccgcgaggtcgtgctgcgcacatccaatggcggcgcgctgatcgccggcgagtggctgcaggccgtgatccgcacccaggggctggacaccatcgtgtccggccactgcatttcgtcctgctcgatcatgcagtccggcggcgtcaaccgttacctcggcggcgatctgccgctggtcgactcggtgcagatccatgccgccagcagcggcggcaggatcacctatgcaccgtctgcgcgcatgacccagatctacaccggcaactacggtggcggcatggatgcgggcctgctgcacaaggccatgtatgaggtggtgcagcccaatggcctgctggtgttccgcgacccggcgcgcaccacgggtacctcggtcaccttcgatccggatggcagcggcagcaagctgcagtcgttcccgggccaggacatccgcagcaacaccatcatcaacacggcgggctaccgcgatccgggcgacaccctgcgtgtcaccagcaacgtcagtggtgacatcaacccgggctacctgcgcaccgcgcgccagctgcaggccttcgtcgacgacgatttcgcgcgctggaataccgactgggcgagtacctacatcaactatgcggtgagcctgtacaacgtctccacgcgcggtccgaacggcatcggtgcacagtcgctgcagcagctgcttgccgatcccgacctccaggacgcgttgcgcggacagctgcggctggctgatctggatgcctcgaccctggccagttccgccggcgtgatccgtgtcagcaatggcgccacctggcgcactgcggaaaccaccggcgctgatttcatgctggtcgacaacggcaccctcgcactggagggcggcgcactgcgcactcccgagctgcgggtgatgccgggcagcatcgtggtcggccatggtgacatcgcatcggtgggcgtggacaccgacgcgctgctggacggcaccggcccgtcctaccgcgaagacggcttcaaccgtctgcgcgtgttcggcacgctgatgccgcgcggtggcgatctggtgacccacggctacgtcaacatcatgcccggcggccaggtgctgttcgacgtcaccgacgccggtggcgccggcagtggccggttgcgcgtcggcagcttccacgatggcggtgccgaagcgggggcgctggtgatcgcacagggcgcacacctggccttgaacgtcgcccagggcttctatcccggtgcctaccgccgcgacctggtggaggggccgatctaccagggtggtttccaggatgtcgtgcggctcggcgatgccggctacagcgccagcatcactgcgggcgacgtgttccgcccgcgccacaattcgctgctcagcttcaacgtcaaccagacggccgatggcctgtggctgaccgccaacccgggcttcgatcagctgggcctgttcggcaacggcacctccggtgatggactggggcgcgcgctggcagccgcatcggaccgccaggacagtggcctgaagtcgctgctcggcgcgcttcagttcaccgaccgcgatgtgatcgcacagcaggctggcgccctgcgcggtgatgcacatgccagcctgcggctggccgacaacgcactgctgggcagcatcggcaacgtggtgcagcagcaccaggcggcgatgcgcagtggcggcgatgccgatggcctggcctcgcaggcggcgcagtcggtctcggcgcagccgggcatgcgccatggcagcctgttcaaccagttggccatgcatctggtcgagccagcgggcgaggctgctggcgacagcggcgtagcgggtcgcagccgtggcctgtgggcgcgcggtttcgccagccatggtcgcatcgacgccgagggtggcgtggccggcctgagccataccgtcggcggcatcgtggtcggtgccgacacccgcgtggccgatgaccgcgtgaccctcggcgtcagcgtggccgcggccgacatgtcgaccaaggccagcgatggcttcggtttcagtggcgacgtgcgtgcgctggatgtgggcggctacctggatgcgacctattcgcgtggctacctgtcggcggccgtgcgctacaccgacctgcgccacgatacccgccgcagcctgtcggccatcgagggcctgcagcaaccgttgcacgcccgatacagcagcgatgcggtctcggcgcgggtcgaacacgcgttctctttcacccgcggcaagggactggtgatccagccgctgctgccggtggtggactacgcgcggacctcggccatccgcttcaacgaagggcagggcaccggtgcgctggtggggcgcagcggcagcctggagagcatccgcgtgggcgccggcctgcaggcgttcaggaccttcgagggcaacaacggcgagcgcatcaccccgcgtgcccgcgtggtctggcagaaggagctgggcgattcgcaggcgcgctacagcaccggctttgctgcggcaccggacctggtgtttggtgccagcagccaggccgtgggcgagcaggtgctggcctggaacctgggcgtgaccagtcgtgccagcgagcgcctgtcgatcatggccgactacgtgggtgagcgccgcgacgggcagatccagaacggcgtgatgctgggcctgggctacaggttctaa

SEQ ID NO: 138 - DNA, 2889 bp, unknown
  environmental sample
atgaagcattcgaagttgagcatcgccctggcaggcctggtgggtatcgcgaccctgggccagatggatgacgtcatggcaatgaattatcacgtgcagggcgatcgcgtcgtgctgagtggcggtgtcaccgtcgccgacgtcgtcgcgctgccggcgctgctggccaaagcgcaggccgaaggccgcccgatccgcgaagtcgtgctgcgcacctccaatggtggcgcgctgatcgcgggtgagtggctgcagggcgtgatccgcaccaacggcctgaataccatcgtgtccggccactgcatctcgtcctgctcgatcatgcagtccggtggcgtcgaacgttacctggccggcgacctgccgctggtcgactcggtgcagatccacgctgccagcaacagtggcaaggtgatctacacgccgtcgccgcggatgaccgagatctacaccggcaactacggcggcggcatggatgccggcctgctgcacaaggccatgtacgaggtggtgcagcccaacggcctgctggtgttccgcgatccggcccggaccaccggcgcttcggtcagcttcgatcccgatggcagcggccgcaggctggagaccttccccggccaggacatctacagcaacaacatcatcaccgccgccggttaccgcgatccgggcgataccctgacggtcaccggcaatgtcagcggcgacatcaatccgggctacctgcgcactgcgcgccagctgcaggcgttcgtcgatgacgacttcgcgcgctggaacgataccgacttcgccaccacgtacatcaactatgcggtgaacatctacaaccgctccagcgccggcccgaacggcatcggcccggcttcggtgcaggattacctcaacgatccgggtacacagcagctccttctgggccagctgcgcctggatgaactggacgcttccacgctgggcaattcggctggcgtgatccgcgtcgccaagggcggcacctggcgcaccgccgaaaccaccggcgccgatttcatgcttgtggagaacggcaccatcgccctggaaggcggcgcattgcgcaccccggagctgcgcgtgctggcggccggcatggtggtcggccacggcgacatcgcctcggttgccaccgactcgaacgcactgctcgatggcaccggcccgtcgtaccgcgaggatggcttcaaccgcctgcgcgtttacggcaccctgatgccgcgtggtggtgacctggttacccatggctacgtcaacatcatgccgggcggcaaggtgctgttcgacgtgactgaagccggcggctcccaggccgggcgcctgcgtgtgggcgacttctacgacagcggcgccaacgagggtgcgctggtcatctcgccgggcgcccaccttgaactgaacgtggcgcagggcttctacgccggcaactaccagcgtgagctggtgagcggcccgatctaccagggcggtttcaccgatgcggtgcgcctgggtgacaccggctatacggccagcatcaccgacggcgaggtgttccggccgcgccacaattcgctgctgagcttcaacatcaaccagaccgccgagggcctgtcgctgaccgccaaccccggcttcgaccagctcgcgcagcttaccggcaacaatggcaacgatggactcggtcgcgcgctggccactgccggccagcgccaggatgccgggctgaagccgctgctgggggcgctgcagttcgcagaccgcgatgtgatcgcccagcaggccggtgcactgcgcggtgatggccatgccagcctgcgcctggccgacaacgcgctggttggcagcatcggcagcgtggtgcagcagcaccaggccgcacggcgcagcggcagcggtgatgccggtggtttggccgcacaggccgcgcaggcggcgtcggcgcagccgggcatggccaatggcagcctgttcaaccagttggcgatgcatctggtggagccggcgggggcgggcggtggcagcaccaacttcggcggcgaagcgccgcgcagccacggcctctggggccgcggtttcggcagccatggccgcatcgacggcgagggcggcgtggccggcctgagccataccgtcggcggcatcgtgctcggtgccgatacgcagctggccgatgaccgggtgacgctgggcgtcagcgttgccgccgcggacatgtcgaccaagggccgcgatggttccggtttcagcggcgacgtgcgcgcgctggatgtgggcggctatctggatgccacctactcgcgtggctacctgtcggcctcggtgcgctataccgatctgcgccacgacacccgccgcagcatcgatggcatcgacggcctgcagggtccgttgcgtgccaagtacaacaacgatgcgatctcggcccggctggagcacggcttctcgttcaccaccgccaagggcgtagtgatccagccgctgctgccggtggtcgattacgcgcgcacctcggccacccgtttcaatgaagggcagggtgccggcgcactggtgggtcgtggtgacagcctggaaagcatccgcgttggtgcgggcctgcaggtgttcaagaccttcgaaggcaacaacggcgagcgcatcaccccgcgcgcgcgcgtggtctggcagaaggaactgggcgacacccaggcccgttacagcaccggcttcgccgctgcgccggacctggtgttcggtgccagcagccagaccgtgggcgagcaggtgctggcctggaacctgggtgtgaccagccgcgccaccgatcgcctgtcggtgatggtcgactacgtgggcgagcgccgcgacggccagctgcagaacggcgtgatgctgggcctgggctatacgttctaa

SEQ ID NO: 139 - DNA, 2991 bp, Stenotrophomonas Sp.
atggcccctgattccattgtgaatgcattcatgtttcgggggctggtgcgctgggggagttttcgccgcccggacgttgaactcctgacccgtgtgttgcgggtggagagagaacacatgaagcattcgaagttgagcctggccctggccgggttgatgggcgtcaccgccatggcggcggttgatgacgtcatggcaatgaattatcacgtgcgggacgatcgcgtcttcctcagcggcggcgtcaccgtcgccgacgtggtggcgctgcccgcactgctggccaaggcgcaggctgaaggccgtccgatccgcgaagtcgtgctgcgcacatccaatggcggcgcgctgatcgccggcgagtggctgcaggccgtgatccgcacccaggggctggacaccatcgtgtccggccactgcatctcgtcctgctcgatcatgcagtccggtggcgtcaaccgttacctcggcggcgatctgccgctggtcgattcggtgcagatccatgccgccagcagcggcggcaggatcacctacgcgccatcgccgcgcatgacccagatctacaccggcaattacggtggcggcatggatgcgggcctgctgcacaaggccatgtatgaggtggtgcagcccaatggcctgctggtattccgcgacccggcgcgcaccacgggtacgtcggtcaccttcgacccggatggcagcggcagcaagctggagacgttcccgggccaggacatccgcggcaacaacatcatcaacacggcaggctatcgcgatccgggcgacaccctccgtgtcaccagcaacgtcagcggcgacatcaacccgggctacctgcgcaccgcgcgccagctgcaggccttcgtcgacgacgatttcgcgcgctggaacaccgactgggccagcgcctacatcaactacgcggtgagcctgtacaacgtctccacgcgggggccgaacggcatcggcacgcagtcgctgcaacagatgctcgccgatcccgacctccaggatgagctgcgcggccagttgcggctggccgatctggatgcgtccaccctggcaagttcggcgggcgtgatccgtgtcagcaacggcgccacctggcgcaccgccgaaaccaccggcgccgatttcatgctggtcgacaacggcaccatcgcgctggagggcggcgcgctgcgtacccccgagctgcgggtgatgccgggcagcgtggtggttggccatggcgacatcgcatcggtcggcaccgacagcgatgcgttgctggatggcaccggcccgtcctaccgcgaagacggcttcaaccgcctgcgtgtgttcggcacgctgatgccgcgtggcggtgatctggtgacccacggctacgtcaacatcatgcccggcgggcaggtgctgttcgacgttaccgaaacgggtggtaccggcagtggccgcctgcgcgtcggcagcttctacgatggcggctccgaggagggcgcgctggtgatcgcgcagggcgcacacctggcgttgaacgtcgcccagggcttctatgccggcacctaccgtcgcgacctggtggaaggaccgatctaccaggggggcttccaggatgccgtgcgactgggcgacaccggctacagcgccagcatcgctgccggtgaagtgttccgcccgcgccacaattcgctgctcagcttcaacgtcaaccagaccgccgacggcctgtggctgaccgccaatccaggcttcgaccagctgggcctgttcaccaacggcacctccggcgacggcctggggcgcgcgctggccgctgcatcggaccgccaggacagcggcctgaagtcgctgctgggtgcgctgcagttcgctgaccgtgatgtgatcgcacagcaggccggcgccctgcgcggtgacgcgcacgccagcctgcgactggccgacaatgcactgatcggcagcatcggcaacgtcgtgcagcagcaccaggcagcgatgcgcagtggtggtgatgcagacgggttggcttcgcaggctgcgcagtcggtctcgtcgcagccgggcatgcgccacggcagcctgttcaaccagttggccatgcatctggtcgagccggccggcgagggtgctggcgacagccgcacggcgagtggcagccgtggcctgtgggcgcgcggtttcgccagccatggccgcatcgatgccgacggcggcgtggccggcctgagccacgatgtcggcggcatcgtgatcggtgccgatacccgcgtcgccgatgaccgcgtgaccctcggcgtgagcgtggccgcggccgacatgtcgaccaaggccagcgatggctccggcttcagcggtgacgtgcgcgcgctggacgtggggggctatctggacgcgacctattcgcggggctacctgtcggcagccgcgcgctacaccgacctgcggcatgacacccgccgcagtgtcggcggcattgatgggctgcagcagcctctgcgcgcgaagtacagcaacgatgccatctcggcacgggtggagcatgcgttctccttcaccactggaaagggtctggtgatccagccgctgttgccggtggtggactacgcacggacctcggccacccgtttcaatgaagggcagggcgccggtgcgctggtgggccgcagcggcagcctggagagcgttcgtgtgggtgccggcctgcagctgttcaagaccttcgaaggcaacaacggcgagcgcatcaccccgcgcgcgcgcgtggtctggcagaaggaactgggtgacacccaggcccgctacagcaccggcttcgccgcagctccggacctgctgttcggtgccagcagccaggccgtgggcgagcaggtgctggcctggaacctgggcgtgaccagccgtgccagcgaacgcctgtcgatcatggccgactacgtgggcgagcgccgcgatggccagatccacaacggcgtgatgttgggcctgggctaccggttctaa

SEQ ID NO: 140 - DNA, 3027 bp, Streptomyces Sp.
ttgtctcaacatcagttcctgcgtgcccgaagacttctcacctccctactgaccggagccgtcctggtcggcggcctcctggccgctccggcgtcctcggccgcctcaggcgcctcggacatctcggcggacatcccaccgcaggaacccggtgtcacgctgcgcgtgttcgacgtgcagacgccgctgagcaagctgtgcaccctcaaaccaggccagacccccaactacgacgcggtgaaagcgacggtggactggtcgacgacggacgacttcggcggcttctccgaccgcttcgtgacagaggtgaccggcaatctggtcgtaccgagcgacggcatctacgcgctgcgtctcatcagtgacgacggttcccggctgaccatcgacgacaccacgatcgtcgaccacgacggactccacggtgcggagccgaaggacggctccgtctcgctcaccgcgggatcgcacccgctgcgcatcgatcatttcgagcgggacggcgggcagcagctgcaactggcctggaagccgccgggcgcggccgacttcaccgtggtgccccgtgaggcgctgaccacggacgcaggcgtcgtccgggtgacggcgccgggacgcaaggagtgcgaggggagcggcgacacccccggtgacggcctgcccctcacagaggtgcgccccgacctgacgctcacggacctgcgccccgacggcttcgaaccgcaggtcaccgggatggactggctgcccgacggccggctggcaatcagcacctggggcggttcggacaacctcgccggagaggtgtacctgctggacaacgtcaccggtgagaccagcaaggacaaggtcaccgtcaagaaggtggcgagtgggctgcgcgagcccatgggcatcaagtacgtcgacggttcgctgtacgtctcgcagaagcacgagctgacccggctcgtcgaccggaaccgcgatgacgtggccgacgagtaccgcaccgtcgcgacctttccgtacggagggaacttccacgagttcgccttcggactcctctaccgcgacggctacttctacgtgaacctgtcggtctccatcaacctcggtggcgcaaccacggttccgcagcccgcgccgggccgcggcaccacgtacaaggtcagcaagaagacgggcaagatcagcccgatcgcgggcgggctccgtacgccgaacggaatcggctggggtccggagggtgagctcttcgccacggacaaccaaggtggctggcttccttcgtcgaagctcatccaggtcaagcagggccgcttcttcaaccactacaccgagccgtccggcgccttcgacgccgcccagccgaccaacccggtgctgtggctgccgcagaacgagatcgccaactcgccgtccacgccgctgtatgtgaagaaggggacgttcgcgggccagatgctgatcggcgacgtgacctacggcggcctgcagcgcgcgtacctggagaaggtgaagggccagtaccagggtgcggtcttccgctacacgcagggccttgaggccggagtcaaccgcctcaccctcggtcccgacggctcgatctacgccggcggtctgggcgccgacggcaactggggccaggagggcaagctcaggttcggcctgcagaagctcacgcccaacggcggtaacaccttcgacatcaagacgatgcgcgccgtaccgggcggcttcgacctgacgtacacccagccggtgtccgcgaagacagccgaggaactggccaagcactaccgggccgaacagtggcggtacaccccgacctccgactacggcggcccgaagatcgccgaagaggtactgcccgtacggtcggccgagctgtcgaaggacgcgcgtaccgtgcggctgcggctggacggcctcaaggaagggcgagtcgtccacctccggtcgccgcgtcccttcacctcggagtccggtgagtcgctgtggaacaccgaggcctggtacacactcaacgccatgcccggcaagcagccgcctccggccacccagtacgaggcagaggaggcccgtctcacgggcacggccggtgtcgccaccgaccatgtcggccactccggcagcggcttcgtcgcccggtacaacacggagggcaaggcggccaccaccttcgacgtgaaggtccgcaagtcgggcacctacgacgtcaacctgcggtactccaacggcccgaacccgttccaggggaccaagtcgctgaccctgtacgccaacgggaagaagctgcggcaggtgaagctcgcctccaccagtgactgggactcctggtccacgcagaccgaggcggtgaagctgcgcgcgggcaacaacaccctctcctaccggttcgacgccggcgacaccgggcacgtcaacctcgacctgatcacgctccgcaagcacggtgcgccgctcgctctgttcgacggcaccgccgcctcgcagtcgcagtggcagcacacggacgggcgacgactggagtggccgctcgccgacgagaagtcgatggaggtatgctgcggtgacatccggaccatcgacgcgtaccaggacttcaagctgcacgccgagttccgcgtgccgctgctgcctgccgacgtcaccggacagaaccgcggcaacagcggaatcttcatccaggaccgctacgaactgcagatcctcgactcctacggtgacacctcgttggacaccaatgaagccggagccatctatctgaagaaggcacccgacgtgaacgcggccaaggcgccggagacctggcagacgtacgacatcgtcttccgcgccgcccgcttcgacgacagtggcaacaaaaccgccgatgcccggctgaccgtggtgtggaacggccagaaggtgcacgacgacatcaccctcgacggccccaccgcttcgggccgggccgagacaccgtcggcgggagcgatccgcctgcaggaccacggcaacaaggtccgtttccgcaacatcagactggaaccgctcagctga

SEQ ID NO: 141 - DNA, 3009 bp, Streptomyces Sp.
ttgtcccaccatctgttcctgcgtgcccgaagacttgtcacctccctagcaaccggagccatcctggccggcggcctctgggccgccccctcgtcctcggccgccccgtccgacatcccgccacaggaacccggagtcacgctgcgcgtgttcgacgtgcagacgccactgagcaaactgtgcaccctcaagcccggccagacccccaaccacgactcgttgaagtcgacggtggactggtccacggccgacgacttcggtggcttctccgaccgcttcgtcacagaggtgaccggctacctggtcgttcccagcgacggcacctacgggttccgtctcaccagcgacgacggctcccggctgaccatcgacgacaccacggtggtcgaccacgacggactccacggcgcggagccgaaggacggcgcggtcacgctcaccgcggggtcgcacccgctgcgcatcgatcacttcgagcgcgacggcgggcagcagctccaactggcctggaagccgccgggcgagagtgacttcgccgtcgtgccccgcgaagcgctgaccacggacgccgacgtcgtccgggtcacggcgcccggacgcaaggagtgcgaggcgagcggcgactcccccggcgacggcctcccgctcacctccgtacggccggacctgacactcaccgatctgcgccccgacggtttcgaaccgcaggtcaccggtatggactggctgcccgacggacggttggcgatcagtacctggggcggctccgacaacgttgccggagaggtctatctgctggacaacgtcaccggtccgacgagcaaggacaaggtcaccttcaagaaggtggccagtgggctgcgtgagcccatgggcatcaagtacgtcgacggttcgctgtacgtctcgcagaagcacgagctgacccggctcgtggaccggaaccgcgatgacgtggccgacgagtaccgcaccgtcgcgacctggccgtacggcgggaacttccacgagttcgcgttcggcctcctctaccgcgacggctacttctacgtgaacctgtccgtctccatcaacctcggcggtgcgaccacggttccgcaaccggccccgggtcgcggaacgacgtacaaggtcagcaagaagaccggcaagatcagcccggtcgcgggcgggcttcgtacgccgaacgggatcggctggggacctgacggtgagctgttcgccacggacaaccaaggcggttggcttccttcgtcgaagctcgtccacgtcaagcaggaccgcttcttcaaccactacaccgagccgtccggcccgttcgatgccgccacaccgaccaatccggtgctgtggctgccccagaacgagatcgccaactcgccctccacgcccctgtatgtgaagaagggcaggttcgcgggtcagatgctgatcggcgacgtgacctacggcggactgcaacgcgcgtatctggagaaggtgaaggggcagtaccagggcgcggtcttccgctacacgcagggacttgaggccggggtcaaccgcctcaccctgggtcccgacggatcaatctacgccggtggtctgggcgccgagggcaactggggtcaggagggcaagctcaagttcggcctgcagaagctcacgcccaacggcgggaacaccttcgacatccagacgatgcgtgccgtaccgggcggcttcgacctgacgtacacccagccggtgtccgcgacgacggccgaggagctggccaagcgctaccgggcggagcagtggcgttacacgccgaccaccgactacggcggcccgaagatcgccgaagaagcgctgcccgtacgatctgccgagctgtcgaaggacgggcgtaccgtgcggctgcggctggacgggctgaagtcgggccgggtcgtccaccttcgctccccgcgtcccttcacctcggcgtccggtgaggcgctgtggagcaccgaggcctggtacacgctcaatgccatgcccggcaagcagccgccgcccgccacccagtacgaggccgaggaggcgcgtctgacgggctcagcgggaatcaacaccgatcatgtcggccactccggcagcggcttcgtcgaccggtactccacggagggcaaggtcgccaccaccttcgacgtgacagtccccaaggcgggcacgtacgacgtcaacctgcgctattccaacggcccgaacccgttccagggcaccaagtcgctctccctgtacaccaacgggaagaagctgcggcaagtgaagctggcctccaccggtgactgggattcatggtccacgcagaccgaaccagtcgtgctgcgcgccgggaagaacaccctctcctacagctacgacccgggcgacaccggacacgtcaacctcgatctgatcactgttcgcccgcacgccgcgccggtcactctcttcgacgggagcgccgcctcacaggccgagtggcagcacacggacgggagacggctcaagtggccgctcaccgacgaggagtcgatggaggtgtgctgcggtgacatccggaccctggacgcgtaccaggacttcaagttgcacgtcgagttccgtgttccgctgctgcctcccgatgtcacgggacaggaccgtggcaacagcggaatcttcatccaggaccgctacgaactccagatcctcgactcctacggtgacacctccctggacaccaacgaagccggagccatctatctgaagaaagcgcccgacgtgaacgcggccaaggcgcccgagacctggcagacgtacgacatcgtcttccgtgccgcccgctacgacgacagcgggaacaagaccgccgacgcgcggctgaccgtggtgtggaacggcgagaaggtgcacgacgacatcgccctcgacggtcccactgcctcgggcagagccgagacaccggcagcgggagcgatccgactgcaggaccacgggaacaaggtccggttccgcaacatcagactggagcctcttgcctga

SEQ ID NO: 142 - DNA, 3009 bp, Streptomyces Sp.
atgccccaccgtctgttcccgcgcgtccgaagacacctcgtccccctcctcgccggagccttcctggccggcgggctgtgctccgccccgccggcttccgccgctcccgccgacctgcctccccaggaaccgggagtcacgctccgcgtgttcgacgtgcagacaccgctgagcaggctgtgcaccctgaagccgggtcagacccccaaccacgaccgactgatgccgacggtcgactggtccacggaggccgacttcggcgggttctccgaccacttcgtcaccgagacgtccggttacctgaacgtgccggaggacggcagctacgcgttccgcctcaccagtgacgacggttcacggctgaccatcggcggcgacaccgtcatcgaccacgacgggctccacgggagcgagccgaaggacggcacggtccatctcaccgccggtccgcacccgttgcgcatcgaccacttcgagcgggacggcggacaacggctgcaactggcctggagaccgccgggcgagagcgacttcgcggtcgtgccccgcgaggcgctgagcaccgacgccggtgtcgtccgggtcaccgcgccgggccgcaaggagtgcgaggcgagcggcgactcccccggcgacggcctgcccctgacctccgtacgccccgacctgaccctcaccgacctgcgtccggacggcttcgagccgcaggtcagcggcatggactggctgcccgacggacggcttgcgatcagtacgtggggcggcaccgacaacgttgccggagaggtgtacctgctggacaacgtgaccggccggacgagccgggagaaggtcaccgtgcggaaggtggcgagcgggctgcgcgaacccatgggcgtcgcgtacgtggacggttcgctgtacgtctcgcagaagcacgagctgacccggctggtcgacaaggaccgcgacggggtgaccgacgagtaccgcacggtcgccacctggccgtacggcgggaacttccacgagttcgccttcggtctgctctaccgggacggctacttctacgtgaacctctccgtcgccatcgacctcggcggcgcgaccaccaccccgcagcccgcgcccgggcgcgggatcacgtacaaggtcagcaagaagacggggcgcatcagccccgtcgcgggcggtctgcggacccccaacggcatcggctggggccccggcggcggcctcttcgccaccgacaaccagggcggatggcttccgtcgtcgaagctcgtccagatcgaacagggccgcttctacaaccactacaccgagcccccgggcgccttcgacgactcccccgtcaccgagccggtgctgtggctgccgcagaacgagatcgccaactcgccctccactccgctgtatctgaagaagggcaccttcgccggccagatgctgctgggcgacgtcacctacggcggtctgcagcgcgccttcctggagaaggtgaagggccagtaccagggagccgtcttccgctacacccagggactcgaggccggcgtcaaccgcatcaccctgggccccgacggcgcgatctacgcaggcggcctgggcgccgacggcaactgggggcaggagggcaagctcaggttcggcctgcagaagctgacgccgaacggcaagaacaccttcgacatccggtcgatgcgcgccgtgcccggtggcttcgacctgacgtacacccagcccgtctccgccgccaccgccgaacagctcgccgcccgttaccgtgccgagcagtggcgctacacaccgaccgcggactacgggggccggaagatcgccgaggaaccgcttcccgtgcgctcggcgacgctctcgaaggacggccgtaccgtcaagctccggctggacggcctgaagccgggccgcgtggtgcacctccgctccccgcgccccttcacctcggcctccggtgaagcgctgtggagcaccgaggcctggtacaccctcaaccggatgcccggcaagcaaccgccccccgccacccggtacgaggccgaggaggcgcgcctcaccggcaccgccggcatcaacaccgaccacgcgggccactccggcagcggcttcgtcgaccgctacgccaccgagggcaaggtcgccacgaccttcgacgtgacggtcccgaagaccggcgcctacgacgtgggcctgcgctactccaacggacccaacccgttccggggcaccaagaccctttccctgtacgccaacgggaagaaggtgcggcagacggagctcgcccccaccggtgactgggactcctggtcgacccggaccgagaaactgacgctgcgcgccggacacaacacgctctcctaccggtacgaccccggcgacaccggccatgtcaacctcgacctgatcaccgtccgcccgcacggagcccgggtcaccctgttcgacgggacggccgcctcgcaggcccagtggcagcacaccgacggaagacgcctgcggtggccgctcaccgacgagaagtcgatggaggtgtgctgcggtgacatccgcaccttggacgcgtaccaggacttccggctgcacgtggagttccgcgtccccctgcttccccccgatgtcaccggacaggaccgcggaaacagcggcatcttcctccaggaccgctacgaactccagatcctcgactcctacggcgacacctcaccgggcaccgacgaggcgggggcgatctatctgaaacgggcgccggacacgaacgcggcgacggcgcccgggacctggcagacctacgacgtcgtcttccgcgcggcccgctacgacgacagcggccgcaagaccgccgacgcccgcgtcacggtggtgtggaacggcgagaaggtccacgacgacgtggccctcgacggaccgaccgcgtcgggccgggcggagagcccggcggcgggcgcgatcaggttgcaggaccacgggaacgaagtcaggttccgcaacatccggatcacccccttggcatga

SEQ ID NO: 143 - DNA, 3009 bp, Streptomyces Sp.
atgcacccacggctgttctcgcgtgcccgaagacacctcatcctcctgctgacctcggccgtcgcgctcggcggcgcctgggccgccccggcgtcctcggcggcccccgccgacatcccgccgcaggaacccggcgtcacgctgcgcgtgttcgacgtccagacgccgctgaacgagctgtgcaccctcaagccgggccagacccccaaccacgacaagctgatgccgacggtcgactggtccaccaccgccgacttcggcggcatcgccgacaacttcgtctcccaggcgtccggttatctggtcgcccctcgtgacggcacctatgtgttccggctcgtcagcgacgacggctcccggctgaccctcgacggcgccacggtgatcgaccacgacgggctgcacggcgcggagcccaaggacggcacggccgaactcaccgcgggagcgcacccgctgcgcatcgaccacttcgaccgcggcggcggccagcaggtgcagctgtcctggatgccgccgggcgagagcgggttcaccgtcgtccccaccgaggcgctgagcaccgacgccggggtcgtccgggtgacggcgccgggccgcaaggagtgcgaggccgggcgcgacacccccggcgacggtctgccgctcacctccgtgcgccccgacctcgacctcaccgacctgcgccccgaaggcttcgagccgcaggtcaccggcatggactggcttcccgacggccgcctggccatcagcacctggggcggcaccgacaacgttgccggagaggtgtacctcctggacaacgtcaccggtgagaccagccgcgacaaggtcaccgtcgagaaggtggcgagcgggctgcgcgagccgatgggcatcaagtacgtggacggctcgctctacgtctcgcagaagcacgagctgacccgcctggtcgacagcgacggcgacgacgtgaccgacgagtaccgcacggtcgccacctggccctacggcggcaacttccacgagttcgcgttcggcctgctctaccgggacggctacttctacgtgaacctctccgtcgccatcgacctcggcggcgcgaccaccaacccgcagcccgcgcccaaccgcggcacgacgtacaagatcagcaagaagaccgggaagatcagtccgatcgcgggcgggctgcgcacgcccaacggcatcggctggggaccgggcggcagtctgttcgccaccgacaaccagggcggctggctgcccgcctcgaagctcgtccagatcaagcaggaccgcttcttcaaccactacaccgagcccgccgggcccttcgaggactcgcccgtcaccgagccggtgctgtggctgccgcagaacgagatcggcaactcgccctccaccccgctgtacctcaccaagggcaggttcgcgggccagctgctgatcggcgacgtcacctacggcggcctccagcgcgcctacctggagaaggtcaagggccagtaccagggcgccgtcttccgctacacgcagggcctggaggcgggcgtcaaccgggtctccatgggccccgacggcgcgatctacaccggcggcctgggcgccgacggcaactgggggcaggagggcaagctcaagttcggcctgcagaagctgacgccgaacgggggcaacaccttcgacgtccagaagatgcgggccgtgcccggcggcttcgacctgacgtacacccagccggtgtccgaggcgacggccgcggagctggcgtcccgctacgaggccgagcagtggcgctacacgccgaccggcgactacggcggcccgaagatcgccgaggaggagctggccgtgcggtccgcgacgctctcggacgacggccgcaccgtgcggctgcggctggacggcctgaagccggaccgcgtcgtgcacgtgcgctccccgcgccccttcacctcggcctccggtgagacgctctggagcaccgaggcctggtacaccctcaacgagatgcccggcaagcagccgcccgcggccaccctgtacgaggccgaggaggcgcgtctgacggggaaggcgggcatcaacaccgaccacatcggctactccggcagcggcttcgtcgaccgctacgccaccgagggcgacgtcaccacgacgttcgacgtgaccgtcccgagggccggcacctacgacgtgggcctgcgctactccaacggcccgaaccccttcgagggcaccaagtcgctgtccctgtacgcgggcgggaagaaggtgcgccagacacagctcccgtccaccggggactgggacacctggtccacccgcaccgagagcgtgcggctgcgggccggccacaacacggtctcctaccgctacgaccccggcgacaccggccacgtcaacctcgacctgatcaccgtgcgcccgcacggcgcgcgggtcgccctgttcgacggcaccgcggcctctcaggagcagtggcagcacacggacgggaggaaggcggcctggccgctggccgaggagcggtcgatggaggtgtgctgcggcgacatccgcaccaaggacgcctaccaggacttcaaactgcacgtggagttccgcgtcccgctgctgccggacgacgtgaccggccaggaccgcggcaacagcggcatctacctccaggaccgctacgagctgcagatcctcgactcctacggcgacaccaccctggacaccaacgaggccggggctatctatctgaagaaggcacccgacaccaacgcggcgacggctccggagacctggcagacgtacgacatcgtcttccgtgccgcccgcttcgacgagaacggcgccaagaccgccgacgcgcgggtgacggtggtgtggaacggagagacggtccacgacgacgtcgccctcgacggtcccaccgcggcgggccgggccgagaccgcggccgccggggcgatccggctgcaggaccacgggaacaaggtccggttccgcgacatccgggtcgaaccgctgaactga

SEQ ID NO: 144 - DNA, 3012 bp, Streptomyces Sp.
atgcgcccacgcctgttccggcgtgcccgaagacacctcgtactcctgctggcgtcggccgtctcggcaggcggtctgctggccgtcccggcgaccgccgcgtccgccgccgcggacgtcccgccgcaggaacccggagtcaccctgcgcgtgttcgacgtgcagacgcccctgagcaagatctgcaccctcaaacccggccagacccccaaccacgacaagctgatgccgagggtcgactggtccagcacggccgatttcggcggcatcgccgacaacttcgtctcggaggcgaccggttacctgatcgctccgcgcgacggcacctacgccttccggctcaccagcgacgacggctcacggctgaccctcgacggcaccacggtcatcgaccacgacggtctgcacggcgccgagccgaaggacggcgcgctcgacctcaccgcgggatcccacccgttgcgtatcgagcacttcgaccgaggcggcgagcagcagctcacgctctcctggcggcccccgggcgagaccgggttcaccgtcgtacccaactcggcactgaccaccgacgccggcgtcgtccgcgtgacggcgccgggccgcaaggagtgcgaggccggcaacgacacgcccggcgacgggctgccgctgacctcggtacgccccgacctcaccctcaccgacctgcgccccgaagggttcgaaccgcaggtcaccggcatggactggctgcccgacggacgcctcgcgctcagcacctggggcggcaccgacaacgttgccggggaggtgtacctgctcgacaacgtcaccggcgcgaccagccgggacaaggtcaccgtgaagaaggtggccgaagggctgcgcgagcccatgggcatcaagtacgtcgacgggtcgctgtacgtctcccagaagcacgaactgacccggctggtcgacgagaacgacgacgacgtgaccgacgcataccgcacggtcgccacctggccctacggaggcaacttccacgagttcgccttcggcctgctctaccgcgacggccacttctacgtgaacctgtccgtcgccatcgacctgggcggcgcgaccaccaccccgcagcccgcgccgaaccgcggaacgacgtacaagataagcaagaagacggggaagatcaccccgatcgcgggcgggctgcgcacccccaacggcatcggctggggccccggcggcggtctcttcgtcaccgacaaccaaggcggatggctgccggcctcgaagctcgtccagatcaagcaggaccgcttcttcaaccactacaccgagcccgccggccccttcgaggactcccccgtcaccgagccggtgctgtggctgccgcagaacgagatcggcaactcgccctcgaccccgctgtatctgaacaagggcaccttcgccggccagatgctgatcggtgacgtcacctacggcggtctgcaacgcgcctacctggagaaggtgaagggccagtaccagggagccgtcttccgctacacgcagggcctggaggccggcgtcaaccgcatcaccatgggccccgacggagcgatctacgccggcggcctgggcgccgacggcaactggggccaggcgggcaagctgaagttcggcctgcagaagctgacgcccaacggcggcgacaccttcgacatccagaagatgcgggccgtgcccggcggcttcgacctgacgtacacccagccggtgtccgacgcgaccgccggggaactggcggcccgctacgacgtccagcagtggcactacaccccgaccgccgactacggcggcccgaagatcgccgaggaggagctgtccgtacgctcggctaccctctcgaaggacggccggaccgtgcggctgcggctggacgggctgaagccggaccgcgtggtccacgtacgctcgccgcggcccttcacctcggcgtccggtgagtcgctgtggagcaccgaggcctggtacacgctcaacgagatgcccgggaagcagccgccgcccgccaccctctacgaggccgaggaggcgcggctcaccggcaaggccggcatcaacaccgaccacgtcggctactccggcagcggcttcgtcgaccgctacgccaccgagggcaaggtcgccacgaccttcgacgtgaaggtccccaagtccggcacgtacgacgtgggcctgcgctactccaacggcccgaaccccttcgagggcaccaagtccctcagtctgtacgccaacgggaagaaggtgcggcagacccagctcccgtccaccggggactgggacacctggtccacacggaccgagcccctgcgcctgcgggccggccacaacaccgtttcctaccgctacgaccccggtgacaccggtcatgtcaacctcgacctgatcaccgtgcacccgcggggcgcccgcgtcgacctcttcgacggcacggccgcctcgcaggcccagtggcagcacacggacgggcggcccgtggcgtggccgctggccgaggaggagtcgatggaggtgtgctgcggcgacatccgcaccaaggacgcctaccaggacttcaagctgcacgtggagttccgcgtcccgcagctgccgcccgacgtgaccggtcaggaccgcggcaacagcggcatctacctccaggaccgctacgagctgcagatactcgactcgtacggggacaccaccccggcgaccgacgaggccggcgccttctacctgaagaaggcacccgacaccaacgccgcgaccgcgccggagacatggcagacgtacgacatcgtcttccgcgcggcccgctacgacgacagcggccgcaagaccaccgacgcgcgggtgacggtggtgtggaacggcgagaaggtccacgacgacgtggtcctcgacggtccgaccgcgggcggccggaccgagacaccggcggccggggcgatccggctgcaggaccacgggaacaaggtccggttccgcgacatccgggtgcagccgctgagctga

SEQ ID NO: 145 - DNA, 2052 bp, Streptomyces Sp.
atgactcgtactcggctgaccgcgctcgccgccacggccgccctcgccgccaccggcggcctgatcaccgccaccccggccgccgccgccgtcacctgcgcctcccctctgtggagggcgcagtacttcggcaactccaccttcagcggcacgccgaagctgaccgcctgcgactccgccgtcgccgaggactacgggtacggcgacccggccggcgtgacgctgcccaaggacaacttctccgtccgctggtccctcacccgggacttcggctccggcggccccttccggctctccgccgccacacaggacggcatgcgcgtgtacgtcgacggcgtgcggaagatcgacctgtggaagaacgtctccacgaccgcccgcaagaccgtcgacctgaccgtcccggccggcaagcacacgctccgcgtggactacgtcgcctggaccggcgtcgcccgcgccgctttcacctacgccccgcgcaccgaggccgccgtcgacgcggtcaagccgctggccccgaccggcctgaccgccgcgtacaaccgggacacctcgaagaccaccctgcgctggaccgcgaacaaggagatggacctcgccggttaccgcgtgtaccggcggctgagcaccacctcgtgggcgcgggtcagcggtgcgtcgctgctcacctcccgctcgttcgtggacgcgacgcccgccacgggccagaccttcctgtacgaggtacgcgcggtcgacaaggcgggccgcgagtccgccggcagcctcgacgcccccgcggtgaccgtggaccgcacgggcccggcggcgccgaccgctctcacggtcgtcggcgacgcgtggtgggccaccctggcctggcaccaggtcgccgacgccacgacgtacgaggtgtacgcctccgccgcggccggcggcccgttcgagctgctgggcacgacgagcacgacgtcgtaccgcaccgacgcacccgagaacaccgcccggtactaccgggtccgcgccctcgacgcgctcggcaacccgtcggcgtacgccgccgtcaccggcgacggtgtcgaccggacgccgccgaagtccccgacctccctcggctccgtcgtcggcgtcggcgacaccgaggtgtactggaaacagcccgacggcttccacgaggacttcgacaacggcggggcataccacgtctaccgctcacccggcacgaccctcgacccggccgcgctcacccgcgtgacctgcgccgaggagagcgacgagaccagcaccggcggcctctgccacgacctggacatgcccgcgggcacatatgtgacgtacgcggtcgtggcggtggacccggccggcaacgagtcggcgctgtccgccccgctcgtcgtccgcaccggcgaccgcgtcccgcccgggcccgtcaccggtgtgaaggccaccccgcgcgccgacggcgtgctggtgagctgggcggcctcgagcgaggacgacgtcgagcgctacgtggcctggaccggtgcccgccaagccgacggcacggtcaagtggctcggctccgcctcctgccgggagggcacgagcgacccgctcgccgtcctgtgcggcgacctgccggacggcgagacgtacgtgtacgcggtcgtcgccagggaccgctggggcaacgcgctgctcccgagcgacccgagggtcacgctcgtcgaggccaccgagctggacgtccggccggagctgacggtcactcgggactgggacctcggcagcatgggctacggcaccgtgatcggcgggcccgacgaggacgggccgtccatcagctggcggtgtgacaagaccgccgagtgcgacagcgtcgcgggctaccgggtcagccggtggaacgcggccacgaaggcgtacgagccgctgcacgcgggactgctgccgtcccagacccgtgcctacacggacaccaccgccgcgcgggggaccacgcacttctacacgctggaggcggtgcgcgccgacggcggcatcgcgggcacccacgtgtggaactgcgtcttccaggaccgcgtctag

SEQ ID NO: 146 - DNA, 2091 bp, Streptomyces Sp.
atgtttcccattggtccggaaggggccccactctctgtgatgactcgtacccggctgaccgcgctggccgcgacggccaccctcgccgccaccggcggcctgatcaccgcctccccggcctccgcggccgtcacctgcacctctcctgtctggaaggcgcagtacttcggcaactccaccttcagcggcacgccgaagctgaccgcctgcgactccgccatcagcgagaactacgggtacggcgacccggccggcgtcacgctgcccaaggacaacttctccgtccgctggtccctcacccgggacttcggctccggcggccccttccggctctccgccgccacgcaggacggcatgcgcgtctacgtcgacggcgtgcggaagatcgacctgtggaagaacgtctccaccaccgcccgcaagaccgtcgacctgaccatcccggccggcaagcacacgatccgcgtggactacgtggcctggaccggcctcgccaacgccgcgttcacgtacgccccgcgcaccgaggccgccgtcgacaaggtcaatccgctcgccccgaccggcctcaccgccgcgtacaaccgggacaccacgaagaccacgctgcgctgggccgcgaacaaggagatggacctcgccggttaccgcgtgtaccgccggctgagcaccacccagtgggcgaaggccggcggcccgtcgctggtcacctccccgtcgttcgtggacgcgacgcccgccacgggccagaccttcctgtacgaggtccgcgccgtcgacaaggcgggccgcgagtccgccggcagccccgacgccaccgccgtgaccgtggaccgcacgggcccggcggcgccgaccggtctcacggtcaccagcgacgcgtggtgggccacgctggcctggcatgggggcgccgacgccgcgaagtacgaggtgtacgccgcctccgcggccgccggcccgttcacgctgctgggcacgacgaccacgacgtcgtaccgcaccgacgcgcccatgaacaccgcccggtactaccgggtccgcgccctcgacgcgctcggcaacccgtcggcgtacgccaccgtcaccggcgacggcgtcgaccggacgccgccgaagtccccgacctccctcggctccgtcgtccgccctggctccaccgaggtgttctggaagcagcccgacggcttctacgaggacttcgacaacggcgggacctaccacgtctaccgctcgcccggtaaaaccctcgacccggccgcgctcacccgcgtgacctgcgccgaggggagcgacgagaccagcgccgacggaaagtgctacgacctgggcatgcccgcgggcacgtacgtgacgtacgcggtcgtggcggtggacccggccggcaacgagtcgacgctgtccgcaccgcacgtcgtccgcaccggcgaccgcgtcgcgcccggaccggtcaccggcgtgaaggccaccccgcgcgccgacggcgtgctggtgagctgggcggcctcgaccgacgacgacgtcgagagctacgtggtccggaacggcacccggcaggcggacggcacggtcaaatggctcggcaccagctcctgctgggagggcacgagcgacccgctcgcggtgctgtgcggcgacgtgccggacggcgagacgtacgtgtactcggtcgttgccagggaccgctggggcaatgcgctgctcccgagcgacccgaaggtcacggtcgtcgaggccaccgagctggacgtccggccgtccgtgacggtcacccgggactgggacctcggcagcgtgggctacgtcaccctgatcggcggacccggcgtgaaggggccgtccatcaactgggagtgcaccaagacggccgagtgcgacaccgtcgcgggctaccggatcagccggtggaacgcggccacgaaggcgtacgagccgctgcacaccggactgctgccgacggatacccgtgcctacacggacaccacggccgtgcagggggccacgtacttctacacgctggaggcggtgcgcgccgacggcagcgtcgcgggcacacacgtgtggggctgcgtcttccaggaccgcgtctag

SEQ ID NO: 147 - DNA, 2052 bp, Streptomyces Sp.
atgactcgtacccggctgatcgcgctggccgcgaccgccgctctcgcggccaccggtggtctgatcaccgccgccccggcctccgcggctgtcacctgcgcctctcccgtctggaaggctcagtacttcggcaactccaccttcagcggcacgccgaagctgaccgcctgcgactccgccgtcgccgagaactacgggcagggcgacccgcccggcgtcacgctgcccaaggacaacttctccgtccgctggtccctcacccgggacttcggctccggcggccccttccggctctccgccgccacgcaggacggcatgcgcgtctacgtcgacggtgtgcggaagatcgacctgtggaagaacgtctccgccaccgcccgcaagacggtcgacctgaccgtcccggccggcaagcacacgatccgcgtggactacgtcgcctggaccggtctcgccagcgccgcgttcacatacgccccgcgcaccgaggccaccgtcgacacggtcaagccgctcgccccggccggcctcaccgccgcgtacagccgggacagcacgaagaccaccctgcgctggaccgccaacaaggagatggacctcgccggttaccgcgtgtaccgccggctgagcaccacttcgtgggcgaaggccagcggcacgtcgccgctcacctccccgtccttcgtggacgccacgcccgccacgggccagaccttcctgtacgaggtccgcgccgtcgacaaggcgggccgcgagtccgccggcggccccgacgccaccgtcgcgaccgtggaccgcaccggcccggcggcgccggccggtctcacggtcaccggcgacgcgtggtgggccaccctggcctggcggggggtcgccgacgccgcgaaatacgaggtgtacgccgctcccaaggccaccggcccgttcgaactgctgggtacgaccgcctcggcgtcgtaccgcaccgacgctcccccgaacaccgcccggtactaccgggtccgcgccctcgacgcgctcggcaacccgtcggcgtacgccaccgtcaccggcgacggcgtggaccggacgccgccgaagtcccccacctccctcggctccgtcgtcggcgccgactacaccaaggtgtactggaagcagcccgacggcttctacgaggacttcgacaacggcgggacctaccgcgtctaccgttcccccggcaggacactcgaccccgccgcgctcacccgcgtgacctgcgccgaggagagcgacgagacgagcaccgacggcatctgccacgacctgggcatgcccgcgggtacgtacgtgacgtacgcggtcgtggccgtggacccgtccggcaaccagtcggcgctgtccgccccgctcgtcgtccgcaccggcgaccgcgtcgcgcccggcccggtcaccggtgtgaaggccaccccgcgcgccgacggcgtgctggtgagctggaccgcctcggccgaggacgacgtcgaacgctacgacgtctggaccggcgcccggcaggccgacggcacggtcaagtggctcggcaccaacttctgcgcggagggcacgagcgatccgctcgcggtcctctgcggtgacctgccggacggcgagacatacgtgtacgcggtcctcgccagggaccgctggggcaacggactgcgcccgggtgacccgaaggccgtggtcgtcgaggccaccgaactggacgtccggccgtccgtgacggtcacccgggactgggacctcggcagcatgggctacggcaccgtgatcggcggacccggccaggacgggccgtccatcagctggcggtgcgacaggacggccgagtgcgacaccgtcacgggctaccgggtcagcaggtgggacccggccgccaaggcgtaccggccgctgcacgccgaaccgctgccggcgcagacccgcgccttcacggacaccacggccacgcgcgggaccacgtacttctacacgctggaggcggtgcgcgccgacggcggcgtcgcgggcacacacacatggaactgcgtcttccaggaccgcgtctga

SEQ ID NO: 148 - DNA, 2283 bp, Streptomyces Sp.
atgtccccctctcaggaatcacacaggcgtcacctgtcttttatgcctcaccgatcccacctgcttcaccgatctcgtctgcctgaccagtctcgtctgcttcacccgtgccgtctgcctccctcatccaatctgtttcacccgtcccacctgcctcgccccccttcaccacctgccccacctctcccatctgttcctcttggtccggaaagggccccgttctccgtgctgactcgtacccgactgatcgctctcgccgcgacggccgtcctcgccgccaccggcggcctcatcaccgccgccccggcctccgcggccgtcacctgcgcctcacccgtctggaaggcgcagtacttcggcaacaccgccttcagcggcacaccgaagctgaccgcctgtgactccgtcatcagcgagaactacgggtacggcgacccggccggcgtcacgctgccgaaggacgacttctccgtccgctggaccctcacccgggacttcggttccggcggcccgttccggttctccgcggccacgcaggacggcatgcgcgtccacatcgacggcgtgcggaagatcgacctgtggaagaacgtctccgccacggcccgcaagaccgtcgacctgacggttccggccggccggcacacgatccgcgtggactacgtggcctggaccggcctcgcccaggccgcgttcacgtacgctccgcgcaccgaggccgccgtcgacaccgtcaagccgctcgccccggccggcctcaccgccgcgtacgaccggaacaccgcgcggaccaccctgcgctgggccggtaacaaggagatggacctcgccggataccgcgtctaccgccggctgagcaccaccacgcagtgggccagggtcggcggctccgcgctgctcaccaccccctccttcgtggacgcgacgcccgccaccggccagaccttcctgtacgaggtccgcgccgtcgacagggcgggccgggagtccgtcggcagccccgacgtccccgccgtgaccgtggaccgcacggggccgaccgcgccgaccggtctcgcggtcaccggcgacgcgtggtgggccaccctgacctggcaggcagtcgccgacgccgcgagctacgaggtgtacgccgccccggcggccgccggtccgttcgcaccgctgggcaccacgaccacgacgtcgtaccgcaccgacgcgcccgtgaacaccgcccgttactaccgggtccgggccctcgacgccctgggcaacccgtcggcgtacgccaccgtcaccggcgacggcgtcgaccggacgccgccggcgtccccggcctccctcggctccgtcgtccgtgccggctacaccgacgtgtactggagacagcccgacggcttctccgaggacttctccaacggggggagctaccgcgtctaccgctcggtcggcaagggcctcgacccggccacgctcacccctgtgacctgtgccgaggggagcgacgagaccgacgacagcggcatctgccacgacctggacatgccggcgggcacctacgtgacgtacgccgtcgccgcggtggacccggccggcaacgagtcggcgctgtccgccccgctcgtcgtccgcaccagtgaccgcgtcgcgcccggcccgctcaccggcgtgaccgccactccgcgcgcggacggcgtgctgatgagctggacgtcctcggccgaggacgacgtcgatcgctacgcggcctggaccggcgtccggcaggccgacggcacggtcaagtggctcgggtccagctcctgccgcgagggcacggcggacccgctcgcggtgctctgcggcgacctgccggacggtgagacgtacgtgtacgcggtggtcgccagggaccgctgggacaacgcgctgcacccgagcgacccgaaggtcaccgtcgtcgaggccaccgagctggacgtccggccgtccgtgacggtcgtccgggactgggagctcggcagcatgggctacggcaccgtgatcggcgggccggacgaggacgggccgtccatcggttggcggtgcgacagcacggcggcgtgcgacaccgtggcgggataccgggtcagccggtggaacgccgccacgcaggcgtacgagccgctgcaccttgggctgctgccggccgggaccagggcctacacggacaccacggccgcgcggggcaccacgcacttctacacgctggaggccgtgcgtgccgacggcggtgtcgtcggcacgcacgtgtggaactgcgtcttccaggaccgcgtctag

SEQ ID NO: 149 - DNA, 1899 bp, Streptomyces Sp.
atgggtcactcccgaaggatccgacgcgcgaagtacgcagcgctcaccggcatggcgtcgcttgcgctcgccgccgccggcctggccggcgtggccggcccggcctccgcgcaggacatctccggctcgacgggcagcgccggcaacgagttcaacccctggagcccgcaggccggccacccctaccggcacggcgcggtacccggcatgtcccagcacgagaactacaagaagtggctcgccgagcacaaccaggccgcggccaccggccagcagaccctgtcctacggcggcggggtcgacggcatcggcgtgcagagcgggcactccaaggtctacctgatcttctacggcaaccagtggggcacccagaccaccgacgccaacgggaacgccaagttctccggcgactcggccggcgcggccggcgccacccagcagatgttcaagggcatcggcaccaacggcgagacctggtccgccgacctgacccagtggtgcgacggccccaacgtcgccaccggcgccgtcagctgcccctccaacgccaacttcatcccgtaccagagcggcggcgtcctgtccggcgtctggtacgacaacgccgccgcctcgccgagccaggccaccggcaaccagctcgcccaggaggccgtcaaggcggccggccacttcggcaacaccaccgccgccgccaaccgggacgcgtactacatcgtcctgtcgccgcacggcaccaacccggacgactaccagaacccgaccaccgggtactgcgcctggcacgactggaacggcgacaccaccctcaccggcggtgcggcgagctcgccctacggcgacatcgccttctccaaccagccgtacaacatcgacgcgggcgccaactgcggcgtcggcttcgtcaactcgcccggcacgctggacggttggacgatgaccctcggccacgagtggcacgagatgatgtccgaccagaacccggccggcggctggaccaaccacgtctcgggcagcagctacaacggccaggagaactccgacgagtgcgcctggatcaggcccggcagcaccggcggcgccgccaacatctccttcggctccttcggcagctacgccgagcaggccagctggtccaacgacaccaactcctgcgcgatctcgcacaccatcctgacccacggcaacacggtcaccgtcaccaacccgggcaaccagtccggcaccgtcggcaccgccgccagcctgcagatcgcggccaccgactcggcctccggccagaccctcacctactcggccaccggcctgccggccggcctgtcgatcaactcctcgaccggcctgatctccggcaccccgaccgccgccggcaccaccagcgtcacggtcaccgcgaccgacaccaccggcgccgccggcagcaccagcttcagctggaccgagtccaccaccggaggcggcggcaacgccgtcaccaacggcggcttcgaggccggcagcctgaccggctggaccgccgccggcagcacctccgccaccaccggcgccgcccacaccggcagctacggcgccatggtcggctccaccaacccgaccggggactcctcgatcgcccagaccttcaccgcgccgaccggctccagcaaggtgtccttctggtacagcaacacctgcgacgacaccgtcacctacgactgggccaccgccaccctgaaggacaacaccaccggcacgaccaccacggtcctcgccaagacctgcaccaccaccggcacctggaccaacaagacggcgaccgtcaccccgggccactcctacaccctcaccctgagcaaccacgacgacaactacccgggtgacccgacctacacctactacgacgacgtgaccgtctcctga

SEQ ID NO: 150 - DNA, 1899 bp, Streptomyces Sp.
atgggtcactcccgcaggatccgacgcgcgaagtacgcggcgctcaccggaatagcgtcgctcgcgctcgccgccgccggcctggccggcgccgccggcccggcctccgcacaggacatctccagctcgcagggcagctccggcagcgagttcaacccctggagcccgcagaacgggcacccgtaccggcacggcgccgtaccgggcatgtcccagcacgagaactacaagaagtggctcgccgcccacaaccaggccgcggccaccggccagcagacgctgtcctacggcggcggcgtcgacggcatcggcgtgcagagcggccactccaaggtctacctggtgttctacggcaaccagtggggctcgcagaccaccgacgccaacggcaacgcgaagttctcgggcgactcggccggggcggccggcgccacccagcagatgttcaagggcatcggcaccaacggcgagacctggtcggcggacctgacccagtggtgcgacggccccgccgtcgccaccggggccgtcagctgcccgtccaacgccaacttcgtcccgtaccagagcggcggcgtcctgtccggcgtctggtacgacaacgcggccgcctcgccgagccaggccacgggcaaccagctcgcccaggaagcggtcaaggccgccggccacttcggcaacaccacggccgccgccaaccgggacgcgtactacatcatcctgtccccgcacggcaccaacccggacgactaccagaaccccagcaccgggtactgcgcctggcacgactggaacggggacaccaccctcaccggcggtgcggcgaactcgccctacggcgacatcgcgttctccaaccagccgtacaacatcgacgcgggctccaactgcggtgtcggcttcgtcaactcgcccggcacgctcgacggttggacgatgaccctcggccacgagtggcacgagatgatgtccgaccagaacccggccggcggctggaccaaccacgtctcgggcagcagctacaacggccaggagaactccgacgagtgcgcctggatccagcccggcagcaccggcggcgccgccaacgtctccttcggcaccttcggctcctacgccgagcaggccagctggtccaacgacaccaactcctgcgcgatctcgcacgccatcctgacccacggcaacacggtcaccgtcacgaacccgggcaaccagaacggcaccgtcggcaccgcggcgagcctgcagatccacgccaccgactccgcctccggccagacgctcagctactcggccaccggcctgccggccggcctggcgatcaacgcctcgaccggcctgatctccggcaccccgaccgccgccggcacctccggcgtcaccgtcaccgtgaccgacaccaccggcgccaccggcagcaccagcttcagctggaccgagtccaccagcggtggcggcggcaacaccgtcaccaacggcggcttcgagaacggcaacctgaccggctggaccgccgccggttccacctcggccacctccgccgccgcccacagcggcagctacggcgccatggtcggctccaccagcccgaccggggactcctcgctcgcccagaccttcaccgcgccgaccggctccagcaaggtgtccttctggtacagcaacacctgcgacgacaccgtcacctacgactgggccaccgccaccctgaaggacaacaccaccggcacgaccaccacggtcctcgccaagacctgcaccaccaccggcacctggaccaacaagacggccaccgtcaccccgggccactcctacaccctcaccctgagcaaccacgacgacaactacgcgggtgacccgacctacacctactacgacgacgtgaccgtctcctga

SEQ ID NO: 151 - DNA, 1899 bp, Streptomyces Sp.
atgggtcactcccgcagcatgcggcgcgccaggtacgcgacgctcaccggaatcgcgtccctggcactcgccgccgccggcctcgccggcgtggccgggccggccgccgcacaggacatccccggtgtcgcgtccagcacgggcaacgagttcaacccctggagcccccagcagggccacccgtaccgccacggtgcggtccagggcctccagcagcacgagaactacaagaagtggctcgccgcgaagaaccaggcggcggccaccggccagcagacgctgtcctacggcggcggcgtcgacggcatcggcgtgcagagcggccactccaaggtctacctggtcttctacggcactcagtggggcacccagaccaccgacgccaacggcaacgccaagttctccaacgactcggccggcgccgccggtgccacccagcagatgttcaagggcatcggcaccaacggcgagacctggtccgccgacctgacccagtggtgcgacggccccaacgtcgccgccggcgccgtcagctgcccgtcgaacgccaacttcatcccgtaccagagcggcggcgtgctctccggcgtctggtacgacaactcggccgcctcgccggcccaggccagcggccaccagctgggcgtcgaggccgtcaacgcggccgcccacttcggcaacaccaccgccgcctcgaaccgcgacgcgtactacatcatcctgtcgcctcacggcaccaacccggacgactaccagaaccccaccaccgggtactgcgcctggcacgactggaacggcgacaccaccctcaccggcggtgcggccagctcgccctacggcgacatcgcgttctccaaccagccgtacaacatcgaccagggcaccaactgcggcgtgggcttcgtcaactcgcccggcacgctggacggttacacgatgactctcggccacgagtggcaggagatgatgtccgaccagaacccggcgggcggctggaccaaccacgtcagcggcagcagctacaacggccaggagaactccgacgagtgcgcctggatcaggcccggcagcaccggcggcgcggccaacatctcgttcggctcctacggcaccttcgccgagcaggccagctggtcgaacgacaccaactcctgcgcgatctcgcacgccatcctgaaccacggcaacaccgtgaccgtcaccaacccgggcagccagagcggcaccgtcggcaccgccgcgagcctgcagatcagcgccagtgactcggccaccggccagaccctgacctactcggccacgggcctgcccgccggcctgtcgatcaactcctcgaccggcctgatctccggcacgcccaccgcctccggcacctccagtgtgacggtcaccgcgaccgacaccacgagcgccaccggcagcaccagcttcacctggaccgagtccaccagcggcggtggcggcaacgcgatcaccaacggcggcttcgagaccggcaacaccaccggctggaccaccaccggcaccgccaccgcccccgccggggccgcgcacaccggttcctacggcctgcagctcggctccaccagcccgaccgccgactccaccgccgcccagaccttcacggcgccgaccggctcgagcaagctgtccttctggtccaagaacacctgcccggacaccctgacctacgactgggcgaccgcgaccctcaaggacaacaccaccaacaccacgaccaccgtgctggccaagacctgctccgcggcgggcgcctggaccaacaccacggccactgtcacccccggccacagctacaccctcaccctcgtcaaccacgacgacaactacgcgggtgacgccacctacacctcctacgacgacgtgaccgtctcctga

SEQ ID NO: 152 - DNA, 2484 bp, Saccharothrix Sp.
atgtccgccctgccgacccgctccgccctgcgcacccgctgggtcggcgccctgaccgccgccgccctggccgccctgggcaccggcaccctggccgccaccccggccgccgccaagcacgccggcgccacctacaccatctccatcggcaagaccggctcctacgcctacccggacgacaccccggcctccgtctacaccgacaaggacggcaccttccacctgcagcagtcccactccctgtacggcgccaaggactcccgccagtgggacttctacaccggcaccgacttcgactccgccacccgctccgccgccatctccgacgccgtcaacccggccaacccggacgaccgcaacaacgacaccacctggcgctgcaacaactccccgaccggcctggaggcctcctacgccccggccggctccggctactcccagaagaacttctgcgacctgtccggcgtctgggtcgacccggacaccggcgactggtacggcctggtccacaacgagttcaccccgcagccgttcggcgacggcctgcactacgacgccatcgactacgccgtctccaccgaccagggcaagacctggtccatcaaggaccacgtcatcacctccccgtactccaccaagcgcggcgacaccgccgccttcccgcagcagaccttctactacggcgacggcgaccagcgcctgttcgtcgacaccgcctccggctacttctacgtcttctacggctcccgcatcgtcgacaagggcggctcctggggcgccttccagcagcacgtcgcccgcgccccgatctccgccaagatgtccccggactcctggcagaagtggtacgacggctcctggacccagccgggcgccggcggcctggagtccgacatggtcccggccgacgccaccaacccgaccggctacctggccccggccaaggagtacgacccgaccaacccgggcaccgtcaagcagcagatcgccgccggcaccctggccccgaccaccccgctgttcgtcatgaacgtctcctacgacgcctacctgggcctgtacatcggctccccgcaggccgtcgaccagtccggcaacgccccgcagcagatctacgccaccaaggacctggccacccagaagtggaccctgctgggcgacaccggcggctaccacaccgcctcctggtaccgctggttcctggactccgccaaccgcaccgactccaccatcgtcggcaagaccttccgcacctactgctccatcgcctgcgccggctccgacggccagtacgtcgacatgaccatcggctcctccgccccggccgccccgccggtcgacctgcgcaagacctaccgcatccagaacggcgacggccgcgtcctggcccaggccgacggcggctccggcaccacctccaccgcccgcccgtccggctccgcccgcgagtcctggtccttcctggccgacggcgacggcgcctaccgcatcgccaacgccgccaccggccagctgctgggcgtcgactccaccgccaccgccggccgcgcctggggcgccggcctgaccgtcaccgacgccgtcggcggcaacgccaccgtcggccagcagtggttcatcctgccgtccaccgccggcaagggcggcttccagctggtcaaccgctactccggcctggtcatcggcctgtccggcaccgccgaccgcctgaccgagaccaccccggcccgctcctggaccgacgccaccggctccaccgtcggcggcggccgcaccgccgacgagcagaccctggccttcaccccgaccggcaccgccccggagaccgtcgtcctgaacgccccgggcgaccagtccggcaccgtcggcaaggccgcctccgtccagctgtccgccaccgacaacgccggcaagccgctgaccttctccgccaccggcctgccggccggcctgtccgtctccccgtccggcctgatctccggcaccccgaccgccgccggcgtcgccaccgtcaccgtcaccgcctcctccggcaccgcctccgcctccacctccctgacctggaccgtcaccccggccctgtccggcaaccacaccctgaccaccggcggcaaggccctggacgacgccgacaactccaccaccgccggcaaccacctgatcacctggaccacctccggctcctccaaccagctgtggcagttccgcccgcagccggacggctcctacgagctggtcaacggccgctcctccatgtgcgccgacgtcaccggcggctccaccgccgccggcgcccaggtcatccagtggccgtgctccggcggctccaaccagcactggaacgtccgcctgaccgccgacggctcctacgccgtcacctccgcccgctccggcctgctgctgaccaccgactcctccgccgacggcgccccggtcacccagcagccggacaccggctccccgctgcagcgctggtccatctcc

SEQ ID NO: 153 - DNA, 2436 bp, Kitasatospora Sp.
atgccgccccgcccccgcgccttacccaccggtctcgccctcctggccgtcctcgccgcccaggccctcggcgccgccccggccccggcggccgccggaacgccgctcgtcgacggcggcggctacctcctcggctccgccctggacggcagctgcctcggcccgcagtacgcccagcccgcccccggcaccccggtggtcggcgccgcctgcgggcgactgctcagccagcgctggcagctgcgccgcgccggcaccgactacctgctcgtgaacgccgccagcggccgctgcctcaccctcggcggcccggaccgccgccccgccaccgccgactgcggcagctcccccgaggccgagcgcttcaccgtctcccgcgcgccgcagggcacctacaccctcaccacccgcggcaccggcggctgcctgaccgccgacccggccccggtggcccaccactgcgacaaccgccccgcccaccgctggacgctcacccgcaccgagccgctggtcctcgccgaccccggcttcgagcagagcgacacgagcgacacgagcggcacgaacgggacgagcggcacgaacggcgccgccaccgccggcagcacctccgacggctggaccttcaccccccacaccggcaccgccaccaacaacccgcacggcggcacccgcctcgcctacctcgacgccggccccggctacgcggtgagccagcaggtgaccgccgtcaccgcgggcagctacgacctgtccgcctggatcgcgacgggcggcgccggcggcagcctctcggtgagcgtcaacggcaccgtggtgcgctccctcccgctgcccgagcagtccctctacgcgaagtacaccctcccccgggtccgggtcgcccccggcgaccggctgaccctcaccatcggctcctcccccacgggttggatcaacgtggacgacgcagccgtcgccccggccgcccccaacgacccggtgatcagctcctccgaccccgaggccgtcgccctcttcgactgggccaaggccaaggccaacagctgggtgcagcaggccggcgccaccagcgtgctcgaccaggacgagaaccaccccggcggcactggcaccaccacctacgacgccacctactgggccggctacccgttccgctccgccttctacagccgcgacttcgcccaccagctggtcggcgcccacctgctcggcctggacgccgagaacaagaccatgctgcgcggcttcgcggcctccgccaccgaggtcaacaagctctacccggtctgggcactcaacttcgacgcccgcagctacggcgccatcgactaccggagccccgaccgcttcgtccgcgagctgcccgcgccgttcgaactcgtccagcagaccggcgaggcctaccgctggaccggcgaccgcgactacgccgaggacccgggcctgggccggtacgtgcgcaacaccctcggcccgttcatcaccgcccgccccggcccggtcgacaacggcggggtgccgatcccgcaggccaccagccgcagcatcttcgccggcaccgccagctatgccgagaacgccacccgcacctacgccgaggccggggacgcggtcggcgcccagtaccaggcctacctctccgccgccgcgctggccgacgcccggggcgacgccgcctccgccgccggctaccggaaggccgccgagcagctgcgcgcgtacgtcaactccacctggagcgtggacggttcgcagcccggcgaggtcgtccacggctacgacaccgccggcaagccgatcaccggctggggctacgaggcgagcgtgctgatgccggtcaaggggctgctcgacccgggcccgcgccgggacgcccagctcgccgccatcgacgccgccgactccggcccggagcgctcggcgaacctggaggcctacacctacctgccggacgccttcttcgccaaccacgacggcagcaccgcctggaagtggatgcggcacgtctacgagagcgtcggcgagccgcacgtgagcggcgcgatgctgaacggcgactaccccgaggtcccgttcaccctgctcgcgcagaccgtccagggcctgctcggcgtcacccccgacgccgccggccacgcgctctccaccaccccgcagctgcccgcctcgatgggctggctccaggtcgcgggcatcccggtgggcggcggcacggtgaccgtccgccacgacggcgcgcagcgcagcaccgtcaccaacaccggtacggagcccgtcacttgggaggcccgcttccccggtcagcacgcccgcgccaccgtcgacggcgagcagcgggaggcccgcaccacgaccgtcgacggcacgacctacacctccatcaccgtgaccctcgcgcccggacactccgcgaccgcgaccgtcaccgactga

SEQ ID NO: 154 - DNA, 1281 bp, Streptomyces Sp.
atgcgtcacttaagatcgaccggccgcttcggcagagagctcatagccttcaccgctgcggctgcctccgcgatagccgccatgagcttcgcggcctcaccggccgccgccgccccggcaaagcccgccgctgcccaggcaaagcccggcgacacctgtacggcggccgacctcggcacacgccacccgtacatcaagagcaccgaagtgtccccgacgatcacccacttcaagggctggtacgtcaccgagggcacgaccggcacccagaccgtcaccaccagcacccagacgaccatctcggtctccgtcggcctcaacggcaatgtcgagggcagtttcgccgtcgagaccctcggcaaggtcggcgcgagcctgggcctgaacgtgaaggtcgactacacctccaccagcaccgagtcgaatgcggtcacgtggaacttcagccagcccggctactacggcgcctacaagggcaccaagaaggtcaccggtacgtacggaagcctcaactgcaaccgcgtccaacagggcgacggcagttgggcgttgaagtggatcgaggggcccgacggcggcaacttcaccacctacaccaccctcgaggaaggcgcggtgcgctgccaggacgaggtgcccgcaggcagcatcatggccaaggcacaaggcctcctcgactgcggctcggctgccgcgaaggccgagcacccggcgggtgcggtggcgccgacggcgaagcaaaagcgggaccgcctcgtgcagcgcccggcgctcaccagcggcacgtccgccgaacagcccaaggccaccgggcgtagcgcgcgggccgctctcgactgcaaggccgaggtctacaagatcgccgtacccggcaagcccctgtcctggggcgcgccgctcctggcggacgacggtgtccgcctgcggccctcgtcgatcttcagcgcccacctggacaactggcgcctgtgcaacgtgacggagaacaacggggtcctcgaggcgtccctgtggaactggggcaacggcgggtgcgcgaccatcgccgagcagaacgcggccactgaacaggcggtcctgcagacggccccctgcacggaggacgacctccagcggttctacatctaccgcgacgtacccggcagctcgaagatcggtgtgcagaacaagtacaccggctccatgatgggtcacgaccgttacgcggacggggagttcatacgccagtactccagcggcaggcaggacggtacgggtacgtacaccctgatcggagtctga

SEQ ID NO: 155 - DNA, 1278 bp, Streptomyces Sp.
atgcgccccacaaagcccgtcagccgcttaggccgagcgctcatggcctgtgcggcctcggccgctgtagccaccgtgggccttgccgtctcaccggcctcggccgcacccgcgaagtccgtcgccgccacgcaggtcaaacccggcgacgtctgcacggctgccgacctcggcacacgccacccgtacatcaagacgaccgaagtcaccccggagataacccacttcaagggctggtacgtcactcagggcgccaccggctaccagagcgtcaccaccagcacccagaccaccatctcggtctccgtcggcctcaacggcaacgtccagggcagcttcgccgtcgagaccctcggcaccgtcggcgcgagcctgggcctgaacgttcaggtcaactactcctccaccagcagcgagtcgaacacggtcacgtggaatttctcccggcctggctactacggcgtctacaaaggcacgaagaaggtcaccggcacgtacggaagcctcaactgcaaccgcgtgcaacagggcagcggcggttgggcgctgaagtggatcgaggggcccggcagcggcagcttcaccacctacaccacccttgaggaaggcgcggtgcgctgcgaggacacggtgccggccaacagcatcatggccaaggcgaagggcctcctcgactgcggctcgcccgccgcgcgggccgagcacccggcgggtgcggtggccccgacgacgaagcagacgcaggaccgcctcgcgcagcgcccggctcccaccagtggcacgtccgccgggcagcccaaggccaccgggcgaagcgcgcaggccgcgctcaactgcgagcccggcgtctacaagatcgacgtccccggcaagcccctgaactggagcgcaccgctcctggccaacgacggcatccgcctgcgcgtatctacgttcttcagcgcccacctggacaactggcggctgtgcaacgttactgagaacaacggagtcctcgaggcgtccctgtggaactggggcaacggcggatgcgcgaccatcccggcgaacatcgccaaccaggagcaggcctacctgacgacggccacctgcggggaggacgacctccagcggttctacatctaccgcgacgtacccggcagctcgaagatcggtctgcagaacaagtacaccggctccatgatgggctacgaccgttatgcggatggagatctgatccgccagtactccagcggcaggcaggacggtacgggtacgtacaccctgaccggagtctga

SEQ ID NO: 156 - DNA, 1278 bp, Streptomyces Sp.
atgcgctccataggacccgtcagtcgcatcggcagatcactcatggtggtgaccgctatggcggccgcctcggcggtttccgccatgagccttgccgccgcaccggctgccgcagcacccaccgacacgacggcgccgcagcccggcgacacctgtacggcggccgacctcggcacacgccacccgtacatcaagaccaccgaagtgtccccgacgatcacccacttcaagggctggtacgtcaccgagggcacaaccggcaaccagaccgtcagcaccagcatgcagacgaccatctcggtctccgtcggcctcaacggcaatgtcgagagcagtttcgccgtcgagaccctcggcaaggtcggcgcgagcctgggcctgaacgtaaaggtcgactactcctccaccagcagcgtgtcgaattcggtcacgtggaacttcagccagcccggctactacggcgtctacaagggcaccaagaaggtcaccggtacgtacggaagcctcaactgcaaccgcgtccaacagggcgacggcagttgggcgctggagtggatcgaggggtccggcagcggcagcttcaccacctacaccaccctcgaggaaggcgcggtgcgctgccaggacagcgtgcccgcaggcagcatcacggccaaggcacaagacctcctcgactgcggctcggccgtcgcgaaggccgagcacccggcgggtgcggtggcgccgacggcgaagcagaagcgggaccgcctcgtgcagcgtccggctctcaccagcggcacgtccgccgaacagcccaaggccaccgagcccagcgcgcgggcggctctcgactgcacggccggcgcctacaagatcgccgtacccggcaagcccctgtcctggggcgcgccgctcctggcggacgacggtgtccggctgcggccctcgacgatcttcagcgcccacctggaccactggcgcctgtgcaacgtgacggagcacaacggggtcctcgaggcgtccctgtggaactggggcaacggcgggtgcgcgaccatcgccgagcagaacgcggccaccgaacgggcggtcctgatgacggccccctgcacggaggacgacctgcagcggttctacgtctaccgcgacgtacccggcagctcgaaggtcggtgtgcagaacaagcacaccggctccatgatgggccacgaccggtacgccgacggggagttcatacgccagtactccagcggcaggcaggacggcacgggcacgtacaccctgatcggagtctga

SEQ ID NO: 157 - DNA, 1230 bp, Streptomyces Sp.
gtgaccgctacggcggccgccatagcggtcaccgccatgggccttgccgcctcaccggctgctgcggcacccaccgacacgacggcgccccgccccggcgacacctgtacggcggccgacctcggcacacgccacccgtacatcaagaccaccgaagtgtccccgacgatcacccacttcaagggctggtacgtcaccgagggcacaaccggcaaccagaccgtcaccaccagcacccagacgaccatctcggtctccgtcggcctcaacggcaatgtcgagggcggcttcgccgtcgagaccctcggcaaggtcggcgcgagcctgggcctgaacgtcaaggtcgactactcctccaccagcagcgagtcgaactcggtcacgtggaacttcaaccagcccggctactacggcgtctacaagggcaccaagaaggtcaccggtacgtacggaagcctcaactgcaaccgagtccaacagggcagcggcagttgggcgttgaagtggatcgaggggcccggcggcggtagcttcaccacctacaccaccctcgaggaaggcgcggtgcgctgccaggacgaggtgcccgcaggcagcatcatggccaaggcacaagacctcctcgactgcggctcggccgccgcgaaggccgagcatccggcgggtgcggtggcgccgacggagaagcagaagcgggaccgcgccgtgcagcgcccggctctcaccggcggcacgtccgccgaacagccgaaggccggcgggcgtagcgcgcgggccgctctcgactgccaggccaacgtctacaagatcgccgtacccggcaagcccttgtcctggggtgcgccggtcctggcggccgacggcgtccgcctgcggccctcgtcgatcttcagcgcccacctggacaactggcgcctgtgcaacgtgacggagaacaacggggtcatcgaggcgtccctgtggaactggggcaacggcgggtgcgcgaccatcggcgcgcagaacccggccaccgaacgggcggccctgatgacggcctcctgcacggaggacgacctccagcggttctacatctaccgcgacgtacccggcagctcgaagatcggtgtgcagaacaagtacaccggctccatgatgggccacgaccggtacgcggacggggagttcatacgccagtactccagcggcaggcaggacggtacgggtacgtacaccctggtcggggtctga

SEQ ID NO: 158 - DNA, 1290 bp, Streptomyces Sp.
atgagccgcttaagatcttccggccgctgggccagagggctggtcgccctcaccgtgaccgctgcatccacgctcgccaccgtaactgccgtggccggccccgccgccgcgacagggcatccgaaacccgcgacaaccgccgaccagccgaagctcggcgacgcctgcacctccgccgacctcggcgcgcgccacccctacatcaagtccaccgaagtggtcccgacgatcacccacttcaagggctggtacgtcaccgagggcacaaccggcaaccagaccgtcaccaccaccacccagacgaccatctcggtctccgtcggcctcaacggcaatctcgagggcggtttcgccgtcgagaccctcggcaaggtcggcgcgagcctggggctcaacgtcaaggtcgactactcctccaccagcaccgagtcgaatgcggtcacctggaacttcaaccagcccggctactacggcgcctacaagggcaccaagaaggtcaccggtacgtacggaagcctcaactgcaaccgcgtccaacagggtgacggcagttgggcgttgaagtggatcgaagggtccggcgacggcagcttcaccacctacaccacccttgaggaaggcgcggtgcgctgccaggacaaggtgcccgcaggcagcatcatggccaaggcacaggacctcctcgactgcggctcggccgccgcgaaggccgagcacccggcgggtgcagtggcgccgacggcgaagcagaagcgggacagcctcgcgcagcgccaggctctcaccaacggcacctccccccaactgcccaaggccaccgggcacagcacgcgggccgctctcgactgccaggccagcgcctacaagatcgctgtacccggcaagcccctgtcctggggcgccccgctcctggcggacgacggcgtccgcctgcggccctcgacgatcttcagcgcccacctggacaactggcgcctgtgcaacgtgacggagaacaacggggtccttgaggcgtccctgtggaactggggcaacggcgggtgcgcgaccatcgccgcgcagaacgcggccaccgaacgggcggtcctgcagacggccccctgcacggaggacgacctccagcggttctacatctaccgcgacgtacccggcagctcgaagatcggtgtgcagaacaagtacaccggctccatgatgggccacgaccggtacgcggacggggagttcatccgccagtactccggcggcaggcaggacggtacgggtacgtacaccctgatcggagtctga

SEQ ID NO: 159 - DNA, 4734 bp, Streptomyces Sp.
atgccacgccacaaggctctcctcatcggagccagcgagtacgacgacgagacgatccgctcgctgcccttcgtccgcgacgacctccagcggctggagggcgcgctctccgaccgggggttccgcccggtggagatcgccgagtcccagcgcggcatcacaccgaacgccgtcaaccgccacgtcctgcgcttcctgcgcgaggccggccgcggcgacaccctgttcatcatgctcagcggccatggggtgcacttcgacggccgggactatctcgtcccggaggacgcctactacgagagcgagcccttcgccgagagctgcgtcgagatcggctggcagaaggagctggaggactcccccgccggccaggtggtcttcctcatcgacgcctgccgggaagggtccgcccgccggaccaagtcccccaccaggatgcccggttgggaacgtcccaagatcgccgcgacactgcgccgcaaggtcgcgtacgtatacgcgtgctccaaggcccagtacgcgctgtacgtggacgagtccgaggccgtcctcccccagcacgccgacgccgccggcacccagccgaaggactcgttcagcctcttctcccgcgccgtcgcggacgtcgtgtcgcaggtcccgcacaccctgcacatgggcgagttcctcgatgaggtgcagcgccgggtgaccgcactgcacacggcgtacggcaagacgccccccgtccagcggatcagggccgagaccgacatcccctggcaggagttcacggtgctgccgggcccggcacgggacgccgccgagcatccctgggtacgcagcacggccacccaccccgtatgggaacggaccgccccgggccccgcccgcgaggcgctcaaggacgtctgcgccactctcgccgcgcggctcgccgaggggtacgacacagcggcggccacgctgcgggacgacccgtggcacgacgccgagctggccaagcgcgcccaggaccggctgggcttcctcaccggccggctggccgccggtacggaactctccccgaccgaaggcgcgttgacggtcctgctcccgctgatcggccaggcgttctggacgcacgaggcggcccagcgggcggccgtggtcaccgcgggcccggccgatcagtccacccccgagcgcgaccgcttcggcaagttcgcccagggcttcccccgcctccagcgccggctgcgcaccctggagcagcgcggcgttgcggacggatcggccgaacgcatccgctggtggctgttccaccgctggctcatccggcagcccgagctgtacgcgtcccagaccctgaagacactgctcggcccgccgccgggcggcccggagtgcccggagtgggtgacggacgccctgtccggcgagcgcttcatgcgtttcctccaggagctgcgggcggcgccgttcgccgtaccccgccacaccgccggccggacgggcgaaccggaccggtcggaccgtaccgaccagcgcgacagcgactacgacgtcatcgccgccagtacgagggacgaacacgaggtacgcgaatccctcgtcgcgtccctcgccaaggccgcccaggcgttcgccgtggacccggtggacctgcccgagatcctcgtggagcacatcgggatctccgacagcgtgaacctcggcgatctgctgacgacgatccgcggctccgactggcgcacctcgggcctcggccgctccctgaacgcggtctgcgagcacccggccgtccagatcgccctgcgcgagcacgcccaccgcgtggacggactgctccgcgacatcaaccggacgtccgcactcgccccgctccgctccctgcccccgtacgccgacgccgaccgcgtcaggctcagcggcaacacccctacgcatctggccgacggcatccgcttccagctcgccgaggaccgggtgcaggagctgctgatgggcgaggagctgtacggcgaacgcgagctggcgatccgggagttgtaccagaacgccctggacgcggtccgctaccgggaccgccgtacggaatacctgcgccggaccgacggtacgccgccggagtgggacggcctcatcgagttcgtccagaaggccgacaccctgggccgcccgtacctggagtgccgggacaacggcgtcggcatgggcctcgacgagctgcgcaacgtcttctcccagggcggtgcccgcttcgtcgacctgccggagtacatcgaggaacagacagcctgggccgagctgggcgagccgcgcatcgagctgcaccccaacagccgtttcggcatcggcgtgctgagctacttcatgctggcggacgagatcgaggtgacgacgtgccgcatgggccgcgacggccgccccggcaacaagtacgtggtcaagatcgcgggcccgggaaacctgttccgcgtcgatgacctggggccgggcacggactcgggcacgacggtgcggctgctgctgaccgaccacaaggagcgcgtctcctgcgtggacacgttgcagcgggtgctgtggctggctccgtaccgtacgagggcggagcacggctcgcgacggcacgagtgggaaccggggcagctctcggtcagcggtcccgaactgtcctggatggacgactcggaaatgttcctgcgctccggggcctgctacccgtcggaggatcccgatgtgtggtgggtggacggtacgggccggttcctcgcggacggcctgctcgcggcgaccaacacgcttaccagcaccagcaccggtgagtcctacggcaccgtggtcaatctgcgcgaacagcaccagccggagctgagcgtcgaccgcaagacgatccgctcgaacgacggaagccatgtcagcgcgctgctgagcggggcactgcccagcctcttctccaccgcgctgccgctcctgacaccggactggctggtggaggtcggcctctcctcgatccgtttcgcggacgaggtggccgaacgggccaggacaagtggggtttcctggcccgtgggggacaccgaacggcccttcgacgccttgggtttcttccgtcccgatcagatgcttctgccgctcgtctccggtcagtacccggcggcccccgagacgcacgggatgtcgtacctgcgcaccatccccgcgccggtactccggtggagactgctcacgctctaccaggcgggcctgggggatgccctgaccgatgcggcgctgtcctcacccgccctgccgtgcgcacggccctcggaccatttgctgctcgccgccgacggtctgtacaccacgctcaactgggccaggagatacaaggagtggctcgccggaccggacaacacgcagaatttcgtcagcgcttcccggttcgtactggactcgggcatgttgagcgcctacgaaatgaccaagtggcgcgatcccgaacaggtggtcaccctcgatgacaccttccagctggtgcagcaagccgaactcaccgccggggacgtcgcggagcgtctgacggctctcggctatcaagttgtccccccgaccggcagcgaggaggtcgggccggaggatctcgccctgctccgtccgttgggcagggccgacgacagctggctggagcccggaagcgagctgtcggtggctcagctctgcttcagcgcggcactggccgagaggtccacgcgcgaggcggccgaccggctccgggagcttgggttcaccgttccctcggagtatccgaactccgacgcctggaccgcggaggaccgcgaggtgctacagcggctgtgggctctgcacgcggatccggtaccggcggaccgggcccaggagatcacctatgcccagctgatcagcgtggcacgcgcctcgggggccaccacgcaggcggtcgtcgacctgctgagggacaccggcttctccgtgccctcctatgacacgcccgagcagacgttccacgacgacgaatgggccctgctcgtctacaacgacatccccctcaatgttgaccgccaagtcccgctgcctcatgcggtgggggtggcgcaccgcaccgggcagacactggaggaggtcgccgtacggttgcgcgcgctcggcttcgagatgcccgaacttcccgccgacggggcgtcgttgagcaaacaggacgtcaacttcctctacgcgcggtacgaacggtcgtccagcagggcatggcccgagccggatcgcccgctggggctcagcgcgatcgcggagcgagcctcccgttccaccctctccatgaccgaaacggccgccagactgagcagcctgggataccactgtgctccggatcagtcgctgctcgcccggctccaggaacatgatctcgacgcgctccggtggaccctccccgacgaggacgatcagaccgtgatctctcccacgcagctgtactcggtggccgagcacctggggcgccacccggaggaagtcgcccagtcgctcacggacttcggctacaacgtcgccgagatccccgacacctggcaccaggaacggaaagcggaagcggatctgatcgacgccctctcacgcggagaagaaccaatcgtcgatatccgctacgaggtcgagatctcgcttcccaccctcgccaccgtggccatgcgcctgaggctgcccttccgtaccgtcgccctcaaagccaccgccctcggcatgcgccacgaggccgagacctggttcgccgccggctga

SEQ ID NO: 160 - DNA, 1374 bp, Streptomyces Sp.
atgagggccctaccagccccaccccgcagaatcgccctgctggcactctccgcactgcttcttctcgtaccggccctgtggccgcggctgacgcagcccgcggcggccgacaccggctccttctcactgctgtacgaccccggccccgcgcacgactgctactcgctggtcgtggaggacccgccggacaagaacacgacccccgatcccggacgcaccagcagcgccggctgcggagccttcgccggcaccgaggagttcacccggaagagccccgagcgtcccacctgggacatcggcacctacggctggaacacctccaactggggcacctcacccggctattccttcaccacccagaccgccgccaagacggtgaccatgcagaacgacgcctccggggtctgcgggctgcacgagaccaacgtcagctacacctaccccgactcccagctcaaacccgggcccgaccgcgcgtaccgcaccgccgcggacggccggatcaacgtctcctaccgtgcgaagatccagcagaccaagcccttcgcctgcggcgagaagcgcgcgctgctcaccacggacctcatcttcgaggactccgagcacggctcggcacaccctgacgtgatctccgtcatccactacgatcccggcacgttcaaggcgcccgacagcaacggtgtcgtctggtacaccagggacgacacgacgatgacctgccccgacggctgccgggtcatggtacgtagccccgacctgatgaaggacgccacctgggcgtcgatcgacgacgacttcagccagttgttcgacaagtacgtcgactacgtcaaccccgagcacctcccgaagtccgacttcgtcctgcgtggcgtgcagatcgtcagcagcaacacgggcagctccacgacggcctcggtcagcgacgtcgacgcgcggatgacgccgaacgcacccgtccacgcacctctgacgtacggcctcaagggcagcgacgggcagtccctgtgcctggacgactacgacaacgccacgaagccgccggccgtcgccgacatctgggactgcaacggcggcgacgcgcaggactggaccatcggccaggacgacaccctccaggtccacggcctgtgcctgggcgcctccggggacggcgcggccgaccatacgcccgtcggactcgacccgtgcgacgggggagcgcatcagaagtgggtcctgggccgctacggccagatctacaaccccgtgtccggccgctgcctggaggtcgcgaacgggtccagcaccaggggcgacaagaacctggaactcttcgactgctggggcggcacccagcagaagtggtggactccggccggcgactaccgctga

SEQ ID NO: 161 - DNA, 1374 bp, Streptomyces Sp.
atgagggccctaccagccccaccccgcagaatcgccctactggcactctccgcactgctcctcctcgtaccggccctgtggccgcgcctgacgcagcccgcggcggccgacaccggctcctcctcgctgctgtacgaccccggccccgcgcacgactgctacgcgctggtcgtggaggacccgccggacaagaacacgacccccgatccgggacgcaccagcagcgccggctgcggtgccttcgccggtaccgaggagttcacccggaagagccccgagcgtcccacctgggacatcggcacctacggctggaacacctccaactggggcacctcacccggctattccttcaccacccggaccgccgccaagacggtgaccatgcagaacgacgcctccggggtctgcgggctgcacgagaccaacgtcagctacacctaccccgactcccagctcaaacccgggcccgaccgtgcgtaccgcaccgccgcggacggccggatcaacgtctcctaccgtgcgaagatccagcagaccaagcccttcacctgcggcgagaagcgcgcgctgctcaccacggacctcatcttcgaggactccgagcacggctcggcacacccggacgtgatctccgtcgtccactacgatcccggcacgttcaaggcgcccgacagcaacggtgtcgtctggtacaccagggacgacacgacgatgacctgccccgacggctgccgggtcatggtgcgcgcccccgacctgatgaaggacgccacctgggcgtcgatcgacgacgacttcagccagttgttcgacaagtacgtcgactacgtcaaccccgagcacctcccgaagtccgccttcgtcctgcgcggtgtgcagatcgtcagcagcaacacgggcagctccacgacggcctcggtcagcgacgtcgacgcgcggctgacgccgaacgcacccgtccacgcacctctgacgtacggcctcaagggcagcgacgggcagtccctgtgcctggacgactacaacaacgccacgaagccgccggccgtcgccgacatctgggactgcaacggcggcgacgcgcaggactggaccatcggccaggacgacaccctccagatccacggcctgtgcctgggcgcctccggggacggcacggccgaccacacgcccgtcgggctcgacccgtgcgacgggggagcgcaccagaagtgggtcctgggccgctacggccagatctacaaccccgtgtccggccgctgcctggaggtcgcgaacgggtccagcaccaggggcgacaagaacctcgaactcttcgactgctggggcggcacccagcagaagtggtggactccggccggcgactaccgctga

SEQ ID NO: 162 - DNA, 1374 bp, Streptomyces Sp.
atgagggccctaccagcccgaccccgcagaatcgccctactggcactctccgcactgctcctcctcgtaccggccctgtggccgcgcctgacgcagcccgcggcggccgacaccggctccgtctcgctgctgtacgaccccggccccgcgcacgactgctatgggctggtcgtggaggacccgccggacaagaacacgacccccgatcccggacgcaccagcagcgccggctgcggtgccttcgccggaaacgaggagttcacccggaagagccccgagcgtcccacctgggacatcggcacctacggctggaacacctccaactggggcacctcacccggctattccttcaccacccagaccgccgccaagacggtgaccatgcagaacgacgcctccggggtctgcgggctgcacgagaccaacgtcagctacacctaccccgactcccagctcaaacccgggcccgaccgcgcgtaccgcaccgccgcggacggccggatcaacgtctcctaccgtgcgaagatccagcagaccaagcccttcacctgcgatgagaagcgcgcgctgctcaccacggacctcatcttcgaggactccgagcacggctcggcacaccctgacgtgatctccgtcatccactacgatcccggcacgttcaaggcgcccggcagcaacggtgtcgtctggtacaccagggacgacacgacgatgacctgccccgacggctgccgcgtcatggtgcgcgcccccgatctgatgaaggacgccacctgggcgtcgatcgacgacgacttcagccagttgttcgacaagtacgtcgactacgtcaaccccgagcacctcccgaagtccgacttcgtcctgcgcggtgtgcagatcgtcagcagcaacacgggcagctccacgacggcctcggtcagcgacgtcgacgcgcggatgacgcccaacgcacccgtccacgcacctctgacgtacggcctcaagggcagcgacgggcagtccctgtgcctggacgactacaacaacgccacgaagccgccggccgtcgccgacatctgggactgcaacggcggcgacgcgcaggactggaccatcggccaggacgccaccctccaggtgcacggcatgtgcctgggcgtgtccggggaccgcacggccgaccacacgcccgtcgggctcgacccgtgcgacgagggagcgcaccagaagtgggtcctgggccgctacggccagatctacaaccccgtgtccggccgctgcctggaggtcgcgaacgggtccagcaccaggggcgacaagaacctcgaactcttcgactgctggggcggcacccagcagaagtggtggactccggccggcgactaccgctga

SEQ ID NO: 163 - DNA, 1374 bp, Streptomyces Sp.
atgagggccctaccagcccgaccccgcagaatcgccctactggcactctccgcactgctcctcctcgtaccggccctgtggccgcgcctgacgcagcccgcggcggccgacaccggctccgtctcgctgctgtacgaccccggccccgcgcacgactgctatgggctggtcgtggaggacccgccggacaagaacacgacccccgaccctggacgcaccagcagcgccggctgcggtgccttcgccggaaccgaggagttcacccggaagagccccgagcgccccacctgggacatcggcacctacggctggaacacctccaactggggcacgtcacccggctattccttcaccacccagaccgccgccaagacggtgaccatgcagaacgacgcctccggggtctgcgggctgcacgagaccaacgtcagttacacctaccccgactcccagctcagacccgggcccgaccgcgcgtaccgcaccgccgcggacggccggatcgacgtctcctaccgtgcgaagatccagcagaccaagcccttcacctgcgatgagaagcgcgcgctgctcaccacggacctcatcttcgaggactccgcgcacggctcggcacaccctgacgtgatctccgtcatccactacgatcccggcacgttcaaggcgcccgacagcaacggtgtcgtctggtacaccaggaacgacacggcgatgacctgccccgacggctgccgcgtcatggtgcgcgcccccgacctgatgaaggacgccacctgggcgtcgatcgacgacgacttcagccagttgttcgacaagtacgtcgactacgtcaaccccgagcacctcccgaagtccgacttcgtcctgcgcggtgtgcagatcgtcagcagcaacacgggcagctccacgacgacctcggtcagcgacgtcgacgcgcggatgacgcccaacgcacccgtccacgcacctctgacgtacggcctcaagggcagcgacgggcagtccctgtgcctggacgactacaacaacgccacgaagccgccggccgtcgccgacatctgggactgcaacggcggcgacgcgcaggactggaccatcggccaggacgacaccctccaggtgcacggcctgtgcctgggcgcgtccggggaccgcacggccgaccacacgcccgtcgggctcgacccgtgcgacgagggagcgcaccagaagtgggtcctgggccgctacggccagatctacaaccccgtgtccggccgctgcctggaggtcgcgaacgggtccagcaccaggggcgacaagaacctcgaactcttcgactgctggggcggcacccagcagaagtggtggactccggccggcgactaccgctga

SEQ ID NO: 164 - DNA, 4338 bp, Streptomyces Sp.
atggggggaagaacgcacctgcaccgcaggcggcggcgcaccgcgccgcaccagctggccgtcatggcggtcctgggggcgctggtcttcggggcagccccgaccgccaccgcggacagcggcgaccccacccccggcaatccgacgcagagcgctctcctccaggctcaggcctccggaaaatctgtcccgatcgactcgctgaccagccagacgtcgaccaccacagccaatccggacgggtcgctcacgacgaccgagtacgtgcagccggtgcgcgtgatgaagaacgacgcctggacaccggtggacgcatcgctcgtgaggaactcggacggctcgttcagtactgcggcgacgcccaacggcgtcacactctccggcggcggcagcgctcccctcgtcagcctcaccgacccggccggacacaacctctcactctccgtgccgttcaccttgccggcgccgacggtcagcggggacaccgcgctgtactcgtcggtcctgcccggcgtcgatctccaggccaccgtcagcgaccagggcggcttcagcgacgtgctgatcgtccacgacgccacggccgccgccaaccccgacctgcgcagactgaccctggcggccaccacccaagggctcagcctcgccggttcggctgacggcgggatgaccgcaaaggcggcggacggcaccaccgcctacaccagcagcgccccggtgatgtgggactcgaccaccactacggccggtccccagaccgcgtccatgcgcctggacgacgccacgagcaccgcctcgcccgccgacgggccggcgccgggggccgacgtcgcgccggtgaccatgacgaccaccagcagcggcctcaccctcacccccgactcgtccatgctcaccggcaccggcaccacctggccggtgtacatcgacccggccgtcgccccgagcgagaccaccaaccactacttcgaggcccagcaaggctgcaactcctcctccgccagctcccacgagtacgactacccgcaacgcttcggcgaaggggtcggttaccagcgctacgcctcgtcgaacggggactgcatcggcgccgagcgcgcgttctacgagctggacaccagcaatctcaacagcagcatggacatcatcaaggcagacctgcatctgacggagacctacgctgaagcctacggctgcacacacacggcacccctgaccctcaagtggaccggacgcatcaccaacggcatgtactgggacacccagcccagcgtcgtctccaccatcggcacccagaatccgaagagcgcctacaacggcgcctacgtcagccagcccaccagttgcggcgaccagggcgtgacgttcacggtgaccgacaagatcgcatccgtcgcggcagccaacgacgccacctggaccgtcggcctgtacggcgacgaggactcctccagcagcgacatcgacttcatgcggtactccaccaacccgtacatccagaccacctacgacatcccgcccgacaccccgaccggcgaggccactgcacccgacgcgcagaacccctccggcgccaactgcggcagcagcacgcgcggctggatcggccagacgacgctgaacggcaacaccagcgacatcacgctcaacgccaagctgaagtccaacgtcagcggcgagaacgtcaaggccgactacacggtctgggacgaccagaccgccaacagcagcggaaacgcggccaccgtcgcgacaccgagcagcggctatgtcgcctccctcaccacggtgaacgtcaacatcggcaccacggtgcaggacggccatcagtacggatggcaggtccgcgcctacgacggaatcaactattccgcctggaacagtccgtgcggcttcaaggtcgacctgaccccgccctcccagccctcagtgaccgcaccgagtgctgtgttcccgccctccggaagcggcaaggcacccaccgggtacgccggccagaccagcagcatcaccgtcaccagcagcgaccccaccccgaccggatgcacccgcggcacctgcctgtccagcgacgtctggcggttctgctacgcactcgacgcacagccggcggtcaactgccccgactacgtcaccgcgacagccaactccagcggaacgcccagcgcatcgatcccgctcgacccgacgacatggggcacacacaccctctacgtcgaagccgaggaccacgccggcaacacccaggcactgcccaccacatacaccttctacgccccctggaacccggccaccaaggtcaccgcgggcgacctcaacggggacggcgtccccgacctgctcggcaccaccaagagcggcgacctcaccctcctgccgggcaacaccgaccccggcaactcccccaccgtcgcctccaccgcagcccagagccccgacggaaaaagcggctggaacgactacctggtcacccaccgcggcagcctcaaacaggacggcctggacgacctgttcgcgtacgacaagaacagccacgacctgtacgtctacaagaacgacggcgccgtctccggaggcaccgccggccacttcaccaacaccgctgacgtctacggccctctcgccagaccccagtgcctccccacggcggacaacaccgccaactgcaccacgtacaacacggccgactggtcctcggtgacccagatgatcgcccccggcgacgtctacgggaccggctaccccgacctggtcacgatcgagaacaagcaactctggctctacaagggctcagcgcaggacagcagctacctcggccccgccaccggcggcaccacgagcaccacgcccgtgctgctcggcaccggcgactggtcccacttcacactcatcgcacccggaaccgtcaacaccacaccgaccctctgggcccgcgacaacaacaccggaaccctctacagcttccccctcaccgccgacagcaacggccagcccccgctgctgacagcgcccagctcattcgcgctgacctccgggctcaccgccaccgacggctccggcctgtgcgcggacgactcccactccgccacccagaacggcaacaagatccagatctggggctgcaacaacaccctcgcccagtcctggacccccgccgcggacggctcgatccgcgtgatgggcaagtgtctggacgtcacccacagcggcaccaccgacggcaccccgatcgacctgtggacctgcaacggcacgggcgcccagcagtggacacccggctccaacaactcactggtcaaccccgaatcgggcaagtgcctggacgaccccaactcctccaccacccccggcacccagctgcagttgcacgcctgcaacggcaccagcgcccagagctggacctccagcgcaccaagcacctggaacagcaaccgcgccaccgcgctgcccgtcacgctcgcgacgagtgactacccgaccatcgcctcgcccggaaacctcaacggaaccacccccggctacccggccctctacacgaccacaccctccggcgaactcatcgaataccccggcgccgcccctgactccaacggcgtggccaccttcggctcgcccgtgacggtcggttactacaacacggcgagcgccgcctggcccctgaacgacggcagcggcaccaccgcagccgattccatcggcaccaacaacgccaccctcaacggccccgccacctgggccacggaccccagccgcggaaccgtcctcagcctcgacggcaccaccggctacgcagcaagcaccaccagcgccctgcagaccggcacccacaccgaccccgccgacggcaccaccaccgacaacaacagcttcagcgtctccgcctgggtcaagctcaacagcctgaccggcaactccaccctcgtctcccagtccgacagcgccggcaacgccaacggcttccagctgtactactcctccggctcccaggtatgggccttcggccgccacaacgacgacaccacgagcaccgcattcacggccgcctacggctccaaagccaccaccggcgcatggacccacctcgtcggcgtctacgacggcccgaccaacaccctcaacctctacgtgaacggaaccctcaccgcgaccaagaccttcgccggcacaccctggaacgccaccggccccgtccagatcggccgccgcctctaccagggcacctacggcgaatacgccaacgccaccgtcagcaacgtccagctctacaacaccgcgctccccccatccgaggtgagcgcactcgactacgaccagaccccctacacccaactcagctga

SEQ ID NO: 165 - DNA, 2061 bp, Streptomyces Sp.
atgccaccccccaccgtccgccgctcccggcgccggctccccgtcgccctgctcgccgccgccctcggagcggtcaccctcggcgccccctcccccgcgtccgcgtcggacaccgccgaggaaacgggccatctcgtcgggcgcggcatcgccgatgtcacgggcgaggcggccgagacggggatgatgggctattccagcttcgaccagaagacctcgggcatccaccagcggcagcggtcccgggccttcgtcgtcgtcgaccggtcgaccggcaagcgcgtggtgtacgtcaacgcggacctcgcgatgatcttccagtccgtccggcagggcgtcatggcacagctgaaggagcgttacggcagcctgtacggcgaggagaacgtcctgctctcggccacccacacccactcggggccgggcgggtactcccacaacgtcgcctacaacctctccgtgctcggcttccagaaggagacctaccgggcgatcgtcgacggcatcacggagtccgtggccgaggcgcacgaggacctgaagcccggcacgatgagcctgggcacggggaccctgaccaacgccagcgtcaaccgctcgcgggaggcgttcgaccgcaatccggccgccgaccgggccgccttccccgacggcatcgacccggcgatgaccgtgctgcgcttcaagcagggcgagaaggacgcgggcgcgatcagctggttcgccacccacaacacctctatcaccaacaagaacacgctcatcagccccgacaacaagggctacgcctcctacgcctgggagcacgaccacgaaggcgtccgctatctcgacgacaccccggggttcgtcgcggccttccccaacaccaacgccggcgacatgtcccccaacctcaacctgaagcccggttccgggcccaccgaggacgagttcgagaacacgcgcatcatcggcgagcgccagctcgacaaggcccgcgagatctacgacgacgcgcggcccgtcgccggaggggtcgactcccggctcacgtatgtcgacatggagagcgtgaccgtacgcccggagtacaccccggacggcaaggagcaccgcacctgccccgccgtcgtgggcgcgtccacgctcgcgggcagcgtcgaggacggcccggccatccccctcttcgaggagggcatgcgcaccccgatcgcccccatcctcgaagcgctgcgcgtcgacaccccgtcctggctcgccacctgccagtaccccaaggcgagcctgatccccacgggcctgctgagcaacgtccacccggtcaccccgaagcggctccccctgcagatcatgaagatcggcgagctgcacctggtggccgccccgggcgagttcacgatcgcctccggcctgcgcgtgcgccgcacggtggccgagcagctgggtgtgccgctggaccgcgtcctgctccaggggtacgccaacgcctacagccagtacgtcacgacgccggaggagtacgacacccagaactacgagggcggctccacgctgtacggccgctacaccctgcccgcctaccagcaggagtacgcccgggtcgcggagtccctgcgcgcgggcacggccctggagcggggcacgatgccggcggacgagtcggggcggcagttcaccttccagacgggggtcgtgtacgacaacccgccctcgggcaaggcgttcggcggagtcctcaaggccccggagagctcgtacgcgcgcggctccaccgccaccgtcgagttcgccaccggccacccgaagaacaacgtccgccggggctccaccttcctggaggtccagcggctggagaacggcacctggaagcgggtcctggacgacggtgactgggagaccacctaccgctggacccggctcaacggactgaccggcacctcgaaggccacgatcatctggaagatcgcggcggacaccgcacccggcacctaccggatcgtgcaccacggggacgcgaagaacctgttcgggaagatcacgccgttcaccggggcgaccgggaccttcaccgtggagtag

SEQ ID NO: 166 - DNA, 2061 bp, Streptomyces Sp.
atgccaccccccgccgtccgcagctcccggcgcaggctccccgtcgcgctgctcgccgccgccctcggagcggtcaccctcggcgccccctcccccgcgtccgcgtcggacaccgccgaggacaccggctacctcgtcgggcgcggtatcgccgatgtcacgggcgaggccgccgagacggggatgatgggctactccagcttcgaccagaagacctcgggcatccaccagcggcagcggtcgcgcgccttcgtcgtcgtcgacaaggcgagcggcaagcgcgcggtgtacgtcaacgcggacctggcgatgatcttccagtccgtccggcagggcgtcatggcccggctgacggagcgttacggcagcctgtacggcgaggacaacgtcctcctctcggccacccacacccactcggggcccggcggatactcccacaacgtcgcctacaacctctcggtcctcggcttccagaaggagacctaccgggcgatcgtcgacggcatcaccgagtccgtggccgaggcgcacgaggacctgaagcccggcacgatgagcctgggcacggggaccctgaccaacgccagcgccaaccgctcccgggaggcgttcgaccgcaacccggccgccgaccgggccgccttccccgacgggatcgacccggcgatgaccgtgctgcgcttcaagcagggcgacaaggacgcgggcgcgatcagctggttcgccacccacaacacctcgatcaccaacaagaacacgctgatcagccccgacaacaagggctatgcctcctacgcctgggagcacgaccacgagggcgtccgctatctcgacgacaccccggggttcgtcgcggccttccccaacaccaacgccggcgacatgtcccccaacctcaatctgaagcccggttccgggcccaccgaggacgagttcgagaacgcgcgcatcatcggtgagcgccagctcgacaaggcccgggagatctacgacgacgcgcggcccgtagccggaggggtcgactcccgcctcgcctatgtcgacatggagaacgtgaccgtacggccggagtacaccccggacggcgaggagcaccgcacctgccccgccgtcgtgggcgcctccacgctcgcgggcagcgtcgaggacggtccggccatcccgctcttcgaggagggcatgcgcaccccgatcgcacccatactcgaagcgctgcgcgtcgacaccccgtcctggctcgcgacctgccagtacccgaaggcgagcctgatacccacgggcctgctgagcaacgtccacccggtcaccccgaagcggctccccctgcagatcatgaagatcggcgagctgcacctggtggccgccccgggcgagttcaccatcgcctccgggctccgcgtacgccgcacggtggccgagcagctgggcgtaccgctggaccgcgtcctgctccaggggtacgccaacgcctacagccagtacgtcacgacgccggaggagtacgacgcccagaactacgagggcggctccacgctgtacggccgctacaccctgcccgcctaccagcaggagtacgcccggatcgcccagtccctgcgcgcgggcacggctctggaccggggcacggtgccggcggacgagtcggggcggcagttcaccttccagacgggggtcgtgtacgacaacccgccatcgggcaaggcgttcggcgcggtcctgaaggccccggagggctcgtacgcgcgcggctccaccgccaccgtcgagttcgccaccggccacccgaagaacaacgtccgccggggctccaccttcctggaggtccagcggctggagaacggcacctggaagcgggtcctggacgacggtgactgggagaccacctaccgctggacccggctcaacggtctgaccggcacctcgaaggccacggtcacctggaagatcgcggcggacaccgcacccggcacctaccggatcgtgcaccacggggacgcgaagaacctgctcgggaagatcacgccgttcaccggggcgacgggaaccttcaccgtcgggtag

SEQ ID NO: 167 - DNA, 2061 bp, Streptomyces Sp.
atgccaccccccaccgtccgccgctcccggcgccggcttcccgtcgccctgctcgccgcagccctcggagcggtcaccctcggcgccccctcccccgcgtccgcgtcgggcgctgccgaggacacgggctacctcgtcgggcgcggcatcgccgatgtcacgggcgaggcggccgagacggggatgatgggctactccagcttcgaccagaagacctcgggcatccaccagcggcagcggtcgcgcgccttcgtcgtcgtcgaccgggcgagcggcaagcgggtggtgtacgtcaacgccgacctcgcgatgatcttccagtccgtccggcagggcgtcatggcgcagttgaaggagcgttacggcagcctgtacggcgaggacaacgtcctcctctcggccacccacacccactcggggccgggcgggtactcccacaacgtcgcctacaacctctccgtcctcggcttccagaaggagacctaccgggcgatcgtcgacggcatcaccgagtccgtggccgaggcgcacgaggacctgaagcccggcacgatgagcctcggcaccgggaccctgaccaacgccagcgtcaaccgttcccgggaggcgttcgaccgcaatccggccgccgaccgggccgccttccccgacggcatcgacccggcgatgaccgtgctgcgcttcaagcagggcgacaaggacgcgggcgcgatcaactggttcgccacccacaacacctccatcaccaacaagaacacgctcatcagccccgacaacaagggctacgcctcctacgcctgggagcacgaccacgaaggcgtccgctacctcgacgacaccccggggttcgtcgcggccttccccaacaccaacgccggcgacatgtcccccaacctcaacctgaagcccggttccgggcccaccgaggacgagttcgagaacgcccgcatcatcggcgagcgccagctcgacaaggcccgggagatctacgaggacgcgcggcccgtcgccggaggggtcgactcccggctcgcctatgtcgacatggagaacgtgaccgtacggccggagtacaccccggacggcaaggagcaccgcacctgccccgccgtcgtgggcgcgtccacgctcgcgggcagcgtcgaggacggcccggccatcccgctcttcgaggagggcatgcgcaccccgatcgcgcccatcctcgaagcgctgcgcatcgacaccccgtcctggctccagtcctgccagtaccccaaggcgagcctgatccccacgggcctgctgagcaacgtccacccggtcaccccgaagcggctccccctgcagatcatgaagatcggcgagctgcacctggtggccgccccgggcgagttcacgatcgcctccggcctccgcgtacgccgcacggtggccgagcggctgggcgtgccactggaccgcgtcctgctccaggggtacgccaacgcctacagccagtacgccacgacgccggaggagtacgacacccagaactacgagggcggctcgacgctgtacggccgctacaccctgcccgcctaccagcaggagtacgcccgcatcgccgagtccctgcgcgagggcacggccctggaccggggcacgtcgccggcggacgagtcggcgaggcagttcaccttccagacgggggtcgtgtacgacaacccgccctcgggcaaggcgttcggcggagtcctcaaggccccggagaactcgtacgcgcgcggctccaccgccaccgtcgagttcgccaccggccacccgaagaacaacgtccgccggggctccaccttcctggaggtccagcggctggagaacggcacctggaagcgggtgctggacgacggtgactgggagaccacctaccgctggacccggctcaacggtctgaccggcacctcgaaggccacgatcacctggaagatcgcggcggacaccgcacccggcacctaccggatcgtccaccacggggacgcgaagaacctgttcgggaagatcacgccgttcaccggggcgaccgggaccttcaccgtggagtag

SEQ ID NO: 168 - DNA, 2061 bp, Streptomyces Sp.
atgccaccccccaccacccgccgctcccggcgcaggctccccgtcgcggtgctcgccgccgccctcggggcggtcaccctcggcgccccctcccccgccaccgcttcgggcgccgccgatgacgggggctatctcgtcgggcgcggcatcgccgatgtcacgggcgaggccgccgagaccgggatgatgggctactccagcttcgaccagaagacctcgggcatccatcagcggcagaggtcgcgcgccttcgtcgtcgtcgaccggtcgagcggcaagcgcgtggtgtacgtcaacgccgacctcgcgatgatcttccagtccgtccagcagggtgtcatcgcccggctgaaggagcgttacggaagcctgtacgacgaggagaacgtgctgctgtcggccacgcacacccactcggggcccggcgggcactcccaccacgtcgcctacaacctctccgtcctcggcttccagaaggagacctaccgggcgatcgtcgacggcatcacggactccgtcgcgaaggcccacgaggacctgaagcccggcacgatgagtctgggcacgggcacgctcaccaacgccagcgtcaaccgctcccgggaggcgttcgaccgcaacccggcggccgaccgggcggccttccccgacgcgatcgacccggcgatgaccgtgctgcgcttcaagcagggcgacaaggacgcgggcgcgatcagctggttcgccacccacaacacttcgatcaccaacaagaacacgctcatcagcccggacaacaaggggtacgccgcctacgcctgggagcacgaccacgagggcgtgcgctatctcgacgacaccccggggttcgtcgcggccttcccgaacaccaacgccggcgacatgtcgccgaacctcaacctgaagcccggatccgggcccaccgaggacgagttcgagaacacgcgcatcatcggtgagcggcagctcgacaaggcccgcgagatctacgacagggcccggccggtggccggaggcgtcgactccaagctcgcctacgtcgacatggagaacgtgaccgtacgcccggagtacaccccggacggcaaggagcaccgcacctgcccggccgtcgtgggcgcgtccacgctggccggcagcgtcgaggacggcccggcgatcccgggcttcgaggagggcacccgcaccccggtcgcgggcatcatcgacgcgctgcgcatcgacaccccgtcctggctgcagacctgccagtacccgaaggcgagcctgatcccgaccggtctgctgagcaacgtccacccggtcaccccgaagatcctcccgctgcagatcatgaagatcggcgagctgcatctggtggccgccccgggcgagttcacgatcacctccggtctgcgcgtgcgccgcacggtggccgagcggctgggcgtcccgctggaccgcgtcctgctccaggggtacgccaacgcctacagccagtacgtcacgacgccggaggagtacgacacccagaactacgagggcggttccacgctgtacggccgctacaccctgcccgcctaccaacaggagtacgaccggatcgccacgtccctgcgcgacggcaccgacccggagcggggcacggcgccgccggacgagtcggcgcggcagttcaccttccagacgggggtcgtgtacgacaacccgccctcgggccaggcgttcggcggggtcctgaaggccccggaggcctcgtacgcgcgcggctccaccgcgaccgtcgagttcgcgaccggccacccgaagaacaacgtccgccggggctccaccttcctggaggtgcagcggctggagaacggctcctggcagcgggtgctggacgacggtgactgggagaccacctaccgctggacccgcctcaacgggctgaccggcacctcgaaggccacgatcacctgggacatcgcggcggacaccgcgcccggcagctaccggatcgtgcaccacggggacgcgaagaacctgctgggcaggatcacgccgttcaccgggacgaccgggaccttcaccgtgcggtag

SEQ ID NO: 169 - DNA, 2061 bp, Streptomyces Sp.
atgccaccccccaccacccgccgctcccggcgcaggctccccgtcgcggtgctcgccgccgccctcggagcggtcaccctgggcgctccctcccccgcgtccgcttcgcacaccgccgacgacggggactacctcgtcgggcgcggcatcgccgatgtcacgggcgaggccgccgagaccgggatgatgggctactccagcttcgaccagaggacctcgggcatccaccagcggcagaggtcgcgcgccttcgtcgtcgtcgaccggtcgagcggcaagcgcgtggtgtacgtcaacgccgacctcgcgatgatcttccagtccgtgcagcagggggtcatcgcccggctgaaggagcgtcacggaagcctgtacgacgaggagaacgtcctgctgtcggccacccacacccactcggggcccggcggacactcccacaacgtggcctacaacctctccgtcctcggcttccagaaggagacctaccgggcgatcgtcgacggcatcgcggagtccgtcgccgaggcgcacgaggatctgaagcccggcacgatgagcctgggcacgggggccctcaccaacgccagcgtcaaccgctcccgggaggcgttcgaccgcaatccagcctccgaccgggcggccttccccggcgcgatcgacccggcgatgaccgtgctgcgcttcaagcagggcgacgaggacgcgggcgcgatcagctggttcgccacccacaacacctcgatcaccaacaagaacacgctcatcagccccgacaacaagggatatgccgcccacgcctgggagcacgaccacgagggcgtgcgccatctcgacgacacacccggttttgtcgcggccttccccaacaccaacgccggtgacatgtcgccgaacctcaacctgaagccgggatcgggtcccaccgaggacgagttcgagaacacgcgcatcatcggcgagcgccagctcgacaaggcccgcgagatctacgacgacgcccggccggtcgccggaggcgtcgactcccggctcgcctatgtcgacatggagaacgtgaccgtacgcccggagtacaccccggacggaaaggagcaccgcacctgccccgccgtcgtgggcgcgtccacgctcgcgggcagcgtcgaggacggtccggcgatccccggcttcgaggagggcacgcgcaccccggtcgcgggcatcatcgacgcgctgcgcatcgacaccccgtcctggctccagacctgccagtacccgaaggcgagcctgatcccgacgggcctgctgagcaacgtccacccggtcaccccgaagcgcctccccctgcagatcatgaagatcggcgagctgcacctggtggccgctccgggcgagttcacgatcacgtccggtctgcgcgtgcgccgcacggtggccgagcagttgggcgtcccgctcgaccgcgtcctgctccaggggtacgccaacgcctacagccagtacgtcacgacgccggaggagtacgacacgcagaactacgagggcggctccacgctgtacggccgctacaccctgcccgcctaccagcaggagtacgcccggatcgcggagtccctgcgcgagggcaccgacctggagcggggcacggcgccgccggacgagtcggggcggcagttcaccttccagaccggggtcgtgtacgacaacccgcccgccggcaaggcgttcggcgcggtcctgaaagccccggaggcctggtacgcgcgcggatccaccgcgaccgtcgagttcgccaccggccacccgaagaacaacgtccgccggggctccaccttcctggaggtgcagcggctggagaacggctcgtggacgcgggtgctggacgacggtgactgggagaccacctaccgctggacccggctcaacggtctgaccggcacctcgaaggccacggtcacctgggacatcgcggcggacaccgcacccggcacctaccggatcgtgcaccacggggacacgaagagcgtgctcgggaagatcacgccgttcaccggggcgaccgggaccttcaccgtgaactag

SEQ ID NO: 170 - DNA, 2007 bp, Streptomyces Sp.
gccgccgccctcggcgcggccaccctcggcgccccttcccccgcgtcggcgtcgaacaccgccgacggcggcgactacctcgtcgggcgaggcatctccgacgtcacgggcgaggccgccgagaccgggatgatgggctactccagcttcgaccagaagacctcgggcatccatcagcggcagcggtcacgggccttcgtcgtcgtcgaccgggcgagcggcaagcgcgtggtgtacgtcaacgccgacctcgccatgatcttccagtcggtccggcagggcgtcatggcccggctgaaggagcgttacggcagcctgtacggcgaggagaacgtcctcctgtcggccacccacacccactcgggacccggcggctactcccacaacgtcgcctacaacctctccgtcctcggcttccagaaggagacctaccgggcgatcgtcgacggcataacggagtccgtcgccaaggcccacgaggacctgaagcccggcacgatgagcctcggcacggggaccctgaccaacgccagcgtcaaccgctcgcgcgaggccttcgaccgcaacccggcggccgaccgggccgccttcccggacgcgatcgacccggcgatgaccgtgctgcgcttcaagcagggcgagcgggacgcgggcgcgatcagctggttcgccacccacaacacctcgatcaccaacaagaacacgctcatcagccccgacaacaagggctacgccgcctacgcctgggagcacgaccacgaaggcgtccgctacctcgacgacacccccgggttcgtcgcggccttccccaacaccaacgcgggcgacatgtcgccgaacctcaacctgaagccgggatccgggcccaccgaggacgagttcgagaacgcgcgcgtcatcggcgagcgccagctcgacaaggcccgcgagatctacgacggcacccggcccgtctccggaggggtcgactcccggctcgcctacgtcgacatggagaacgtgaccgtacgcccggagtacgccccggacggcaaggagcaccggacctgccccgccgtcgtgggcgcgtccacgctcgcgggcagcgtcgaggacggcccggccatccccctcttcgaggagggcatgcgcacgccgatcgcccccatcctcgaagcgctgcgcgtcgacaccccgtcctggctcgcgacctgccagtaccccaaggcgagcctcgtccccacggggctgctgagcaacgtccacccggtcaccccgaagcgcctcccgctccagatcatgaagatcggcgagctgcacctggtggccgcacccggcgagttcacgatcgcctcgggcctgcgcgtacgccgcacggtggcccggcagctcggcgtgccgctggaccgcgtcctgctccaggggtacgccaacgcctacagccagtacgtgacgacaccggaggagtacgacacccagaactacgagggcggctccacgctgtacggccgttacaccctgcccgcgtaccagcaggagtacgaccggatcgcgaagtccctgcgcgagggcacgacgctggatcggggcacgatgccggcggacgagtcggggcggcagttcaccttccagaccggggtggtgtacgacaacccgccctcgggcaaggcgttcggcggggtcctcaaggccccggagccctcatacgcgcgcggctccaccgcgaccgtcgagttcgccaccggacacccgaagaacaacctccgccggggctccaccttcctggaggtgcagcggctggtgaacggctcctggcagcgggtgctggacgacggcgactggggaaccacctaccgctggacccggctcaacgatctgaccggcacctcgaaggccacgatcacctgggacatcgcggcggacacggaccccggcacctaccggatcgtgcaccacggggacgccaagagcctgctcgggaagatcacgtcgttcaccgggacgacgggcggcttcaccgtgcggtag

SEQ ID NO: 171 - DNA, 2061 bp, Streptomyces Sp.
atgccaccaccccccagccgctccccccgcaagctctccgccctcgtactcgccgccgcgctgggagccgcggctctcggcgccccctcctccgcatcggccgcaccggccgccgacgacggggagtacctcgtcggacgcggcatcgccgatgtcaccggggaggccgccgagaccgggatgatgggctactccagcttcgaccagaagacgtccggcatccaccagcgccagcggtcccgcgcgtacgtcgtggtggaccgggcgaccgggaagcgcgtggtctacgtcaacgccgacctcgcgatgatcttccagtccgtgcagcagggtgtcatcgcccgcctcaaggagcgttacggcagcctgtacggcgacgagaacgtgctgctctccgccacccacacccactcgggccccggcggctactcccaccacgtcgcgtacaacctctccgtgctcggcttccagagcgccacctaccgggcgatcgtcgacggcatcgccgactccgtggccaaggcccacgacgacctgaagcccggcaccatcagcctgggcaccggcaccctcaccaacgccagcgtcaaccgctcccgcgaggccttcgaccgcaacccggcggccgaccgggcggccttccccgacgggatcgacccggcgatgaccgtgctgcggttccggcagggcgagagggacgcgggcgcgatcagctggttcgccacccacaacacctcgatcaccaacaagaacaccctcatcagccccgacaacaagggctatgcctcctacgcctgggagcacgaccacgagggcgtgcgctatctcgacaacaccccgggtttcgtcgccgcgttccccaacaccaacgccggggacatgtcccccaacctcaacctgaagcccggatcggggcccaccgaggacgagttcgagaacacccgcatcatcggcgagcgccagctcgacaaggcccgcgaggtgtacgccggtgcgcggccggtgaccggaggggtcgactcccgtctcacctatgtcgacatggagaacgtcaccgtacgcggcgagtacacgacggacgggaaggagcagcgcacctgccccgccgtggtgggcgcctccacgctcgcgggcagcgtggaggacggtccggcgatccccggcttcgaggagggcgcgcgcaccccggtcgcgtccatcatcgacgcgctgcgcatcgacaccccgtcgtggctcgcgacctgccagtacccgaaggcgagcctgatccccaccggcctgctgagcaacgtccacccggtcaccccgaagatcctccccctccagatcatgaagatcggggagctttacctggtggcgggaccgggcgaattcacgatcacggccggactccgggtccgccggaccgtggcccaggagctcggggtcccgctggagcgggtgctgctgcaggggtacgccaacgcctacagccagtacgtgacgacaccggaggagtacgaaacccagaactacgagggcggctccacgctctacggccgcaacacgctccccgcctaccagcaggagtacgcgcgggtcgcggcctccctgcgccagggcaccgcgatcggccggggcacggcaccgccggacgagtcggcccggcagttcacgttccagacgggcgtcgtgtacgacaacccgccgcttggcaagtccttcggcgcggtcctgaccgcaccggcctcctcgtacgcacgcggctccacggcgaccgtcgagttcgccaccggacacccgaagaacaacgtgcgccggggctccaccttcctggaggtgcagcggctggagggcggctcgtgggtgcgggtcctggacgacggtgactgggagaccacgtaccgctggacccggatcaacggtctgacaggtacgtcgaaggcgacggtcacctgggccatcggggcggacaccgctcccggcacctaccggatcgtgcaccacggggacgcgaagaacctgctggggaagatcacaccgttcacgggggcatccccgacgttcaccgtgagcgggtga

SEQ ID NO: 172 - DNA, 2058 bp, Streptomyces Sp.
atgccaccacgccccagccgctccccccgcaagctctccgccctcgtcctcgccaccgccctgggagccgtggctctcggcgccccctcccccgcatcggccgcgccggccgccgaaccggactacctgatcgggcgcggcatcgccgacgtcaccggggaggccgccgagaccgggatgatgggctactccagcttcgaccagaagacctccggcatccaccagcggcagcggtcacgcgcgtacgtcgtggccgaccgggcgaccggcaaacgcgtggtctacgtcaacgcggacctcgcgatgatcttccagtccgtacggcagggcgtcctcgcccgcctagaggagaagtacggcagcctgtacggcgaggagaatgttctcctctccgccacccacacccactcgggccccggcggctactcccaccacgtcgcgtacaacctctccgtgctcggcttccagaacggcacctaccgggcgatcgtcgacggcatcgccgagtccgtcgccaaggcccacgacgacctgaagcccggcacgatcagcctgggcaccggcaccctcaccaacgccagcgtcaaccgctcgcgcgcggccttcgaccgcaacccggcggccgaccgggcggccttccccgacgggatcgacccggcgatgaccgtgctgcggttccgccagggcgacaaggacgcgggcgcgatcagctggttcgccacccacaacacctcgatcaccaacaagaacacgctcatcagcccggacaacaagggctatgccgcctatgcctgggagcacgaccacgagggcgtgcgctatctcgacaacaccccgggattcgtcgccgcgttccccaacaccaacgcgggcgacatgtccccgaacctcaatctgaggcccggatcggggcctaccgaggacgagttcgagaacacgcgcgtcatcggtgagcgccagctcgacaaggcccgcgaggtctaccgggacgcgaagccggtgaccggcaggatcgactcccgcctcacctacgtggacatggagaacgtcaccgtacgcgggcagtacacgagcgacggcaaggaggcccggacctgtcccgccgtcgtgggcgcctccaccctcgcgggcagtgtggaggacggcccggcgatccccggcttcgaggagggcatgcgcaccccggtcgcgtccatcatcgacgcgctgcggatcgacaccccgtcctggctcgcgacctgccagtacccgaaggcgagcctggtccccacgggcctgctgagcaacgtccacccggtgaccccgaagatcctcccgctccagatcatgcggatcggggagctgtacctggtggcgggcccgggcgagttcacgatcacggccgggctccgggtccgccggaccgtggcccaggagctcggcgtcccgctggagcgggtgctgctccaggggtacgccaacgcgtacagccagtacgtgacgacgccggaggagtacgacacgcagaactacgagggcggctccacgctctacggccgcaacacgctccccgcctaccagcaggagtacgccaaggtcgcggcctccctgcgccagggcaccccgatcggccggggcacggcaccgccggacgagtcggcccggcagttcaccttccagacgggcgtggtgtacgacaacccgccgctcggcaaatccttcggctcggtcctgaccgcaccggcctcctcgtacgcacgcggctcgacggcaaccgtcgagttcgccaccggacacccgaagaacaatgtgcgccggggcggaaccttcctggaggtccagcggctggaggccgggaagtgggtgcgggtgctggacgacggtgactgggagaccacgtaccgctggacccggatcaacggtctgaccggtacgtcgaaggccacggtcacctgggacatcgggccggacaccgcccccggcacgtaccggatcgtgcaccacggggacgcgaagaacctgctggggaagatcaccccgttcacgggcacgtccccgacgttcaccgtgaccggctga

SEQ ID NO: 173 - DNA, 2082 bp, Streptomyces Sp.
atgtcaccccccaccccccgtcgttccagaggcagactcgccgtcctggcgctcgtcgcggccctgggagccgcctcgttcaccgcgcctcccccggccctggcgtccagcgacaccaactccgccgacgcaaccgccgccgacgcggactacctcgtcgggcgcggcatcgccgacgtcaccggcgaggccgccgagaccggcatgatgggctactcgaacttcgaccagaagacgtccggcatccatcagcggcagcgctcacgggcgttcgtcgtcgccgaccggacgagcggcaagcgcgtggtgtacgtcaacgccgacctggccatggtcttccagtccgtacggcagggcgtcctcgccggcctcaaggagcgctacggcagcctgtacggcgaggagaacgtcctgctgtccgccacccacacccactcggggccgggcggctactcgcacgacgtcgcgtacaacctctccgtgctcggcttccagagcgccacctaccgggccgtcgtcaacggcatcgtcgagtccgtcggcaaggcccacgaggatctgaagcccggcaccatcagcctgggcacgggtacgctcaccaacgccagtgtcaaccggtcccgtaccgccttcgaccgcaatccggcggccgaccgggcggccttccccggcggcatcgacccggccatgaccgtgctgcggttccggcagggcgacaaggacgcgggggcgatcagctggttcgccacccacaacacctcgatcaccaacaagaacacgctcatcagccccgacaacaagggctacgcctcctacgcgtgggagcacggcctggagggtgtgcggtatctcgacaacaccccggggttcgtcgccgcgttccccaacaccaacgccggggacatgtcccccaacctcaatctgaagccgggatccggcccgaccgaggacgagttcgagaacgcgcgcatcctcggtgaacgccaactcgacaaggcccgggcgatcttccgggacgcgaagccggtcggcgggggcgtcgactcccgcctcgcgtacgtcgacatggagagcgtgacggtgaacggggcgtacaccccggacggaaaggaacaccgcacctgccccgccgtcgtcggcgcgtccacgctcgcgggcagcgtcgaggacggtccggcgatccccggcttcgaggagggcatgcgcacgccggtcgcctccatcatcgaggcgctccagatcgacaccccggactggctggccgcctgccagtacccgaaggcgagcctggtccccacgggtctgctgagcaacgtccatccggtgaccccgaagatcctgccgctccagatcatgaggatcggcgagctgtatctcgtcgcggggccgggcgagttcaccatcacctccggtctgcgcgtccgccgtacggtggccgagcagctcggtgtcccgctcgaccgggtcctgctccaggggtacgccaactcctacagccagtacgtgacgacacccgaggagtacgacagccagcagtacgagggcggctccacgctctacggccgctacacgctgcccgcctaccagcaggagtacgcacgggtcgcgaagtccctgcgcgagggctccgcgctcgaccggggtacggcgccgccggacgagtcgggccggcagttcaacttccagaccggtgtggtgtacgacaacccgccgcccggcagcacgttcggcggcgtactgaccccgccggacgcgtcgtacgcccggggccgtaccgcgacggtcgagttcgccaccggacacccgaagaacaacctccgccggggcggcaccttcctggaggtgcagcggctggtcgacggggcgtggacgcgggtgctggacgacggtgactggagcacgaagtaccgctggacgcgtatcaacggtcttaccggtacgtcgaaggccaccgtcacctgggacatcgccgcggacaccgctcccggcacctaccgggtcgtgcaccacggcgactcgaagaacctgctcgggaagatcacaccgttcacggggacgtcccccacgttcacggtgagctga

SEQ ID NO: 174 - DNA, 2421 bp, Bacillus Sp.
atggttcattttaaaaactgccctgatccttctctaaacgccaattctcagtctcaccccgaattttcatccgaattagaacatattaagacaagaatgcaaaactttattaagcactcggttacagaccaaaatatcgaagttactgacgcaagggtgacggccgaaggagaggtcacctctcttttaaaagaacgtctcgacaaggaatattataggcttttatctaaaatcacccgggaagtaaatgtggctgacttcggcgctgttccagatggaagagacaatactgaagcttttcgaaaagcaatcgggaatggccgagtcaaagtacatgttccagcgggagaatacctcgttcaagggattaaacttccatcttggacaacaattgttggacaaggtaaagggatcacagtgattaaattgcatgaagacactccagcgcatgaatgggtgattacaaatgatgattatcaaaatggaaatcgcaatatttttgtccaaggaatgtcattagactggaatccaagtagacaatgcggtgtgagaaatccagggggacagttctccagttgtttaacttttgctaaggttgaatatgggtggatcaaagatgtggaagcgattaacgcaggtcttcatggtattgatattacatcgccaacgtatgaccatttgcctgataccgattggacaaaagacggatcaagatatatttggatcgataactgtgtgacatatggttcaggagacgacggcattaccacccattatagcgaatacatctttatttcaaactgccattcaggaaatccgcggggaacagaatttgctgaaggtgtttcaaactccaacggaatagaaattgacgacggctctaggcatgtgtggcttttgaataactttacaagcggcaacatccgcggagttgaagtaaaagcccatgaactgtggccagcctctcaaaacgtccatatcataggccatatttcttatcgcgatgttcgtgcatttgatcttcgtcatattggtcaccatcaaattacagatcctgaaagcacaacagcatacgatgtcacactcattgattgttcagcagttgaaccagttttcaactcgctttacgatgctgtgaccccaagagcgctggttatttcggcatataaaaacgttaatgtaagcggattcacagcgattggtgatccagactatgattataaagaaaaccctgtcgtagccttgcaatatcgcagccaaaatataaccattaatggtattaaaattcgcggttttaaaaaagccggtgttgatattaatttatcaggcggatcaaataaaactgattatattaaaatttcaaattttgatatttataaatctgctccaaaaggaatttcaatcggtggaggcctctacaatgtcaatattctaaatggaacgatgattactgacaatgggacagttgcaattcagtcccccaataatcaggccacaattctcggtgtacaatcagaaggttatagtgtggcagcctcaatcaaaggccaaacataccaacaagttccaatcaatttgaaaggaggcatacagcttgcaacgacctctggctttgccgttaaccaaacaagcgcagttatagcaggtaccggcgacattacggcccgcggagaaagaaatgcggtcattagctcttctggaggctccagtactgaaggctctcgcgcattaatcgcttcttcaaataacgcacatattagaggaaaccaagcgtcaagaacaatactgtcttctgaaaatattatacttgaggaaccatacaccgtggcaggaggtcatcaatcaataaagtggcttcttgactctgttcggggaaacgggacgtttgccggtgcaatcagttcttctttaggtggatatggagagtattttgagagttcaactggacagttaatccatactggtacaatcgtgactttaagaggtgaaaaaattgtgcccgcgaatgttggagattatatgcttggcgttatttcagaaacttcagctttcatttcaggagcctccagtttcgtctggcagggccgttatttgacaaatgagttcggcggatttatttatgaaacggtgactgatgaggaaagcggtgaactcatacgtgttcccaaacaaaatccagactacgatacagcgctggaggcaaattatcattcacgggcagcaagagacgaatggcacgttgtagggttggttggccaacattatgtgcgtattgacgaaactgtcaatcaaggagattatcttacggcacataatggaataggaacaaaagccactgaaggaagctggaaagtaatgaaaataacctctgcttacacatcagaaaaagggtatggtatcgctctaaccgtcatcaaatag

SEQ ID NO: 175 - DNA, 2421 bp, Bacillus Sp.
atggttcattttaaaaactgccctgatccttctctaaacgccaattctcagtctcaccccgaattttcatccgaattagaacatattaagacaagaatgcaaaactttattaagcactcggttacagcccaaaatatcgaagttactgacgcaagggtgacggccgaaggagaggtcacctctcttttaaaagaacgtctcgacaaggaatattataggcttttatctaaaatcacccgggaagtaaatgtggctgacttcggcgctgttccagatggaagagacaatactgaagcttttcgaaaagcaatcgggaatggccgagtcaaagtacatgttccagcgggagaatacctcgttcaagggattaaacttccatcttggacaacaattgttggacaaggtaaagggatcacagtgattaaattgcatgaagacactccagcgcatgaatgggtgattacaaatgatgattatcaaaatggaaatcgcaatatttttgtccaaggaatgtcattagactggaatccaagtagacaatgcggtgtgagaaatccagggggacagttctccagttgtttaacttttgctaaggttgaatatgggtggatcaaagatgtggaagcgattaacgcaggtcttcatggtattgatattacatcgccaacgtatgaccatttgcctgataccgattggacaaaagacggatcaagatatatttggatcgataactgtgtgacatatggttcaggagacgacggcattaccacccattatagcgaatacatctttatttcaaactgccattcaggaaatccgcggggaacagaatttgctgaaggtgtttcaaactccaacggaatagaaattgacgacggctctaggcatgtgtggcttttgaataactttacaagcggcaacatccgcggagttgaagtaaaagcccatgaactgtggccagcctctcaaaacgtccatatcataggccatatttcttatcgcgatgttcgtgcatttgatcttcgtcatattggtcaccatcaaattacagatcctgaaagcacaacagcatacgatgtcacactcattgattgttcagcagttgaaccagttttcaactcgctttacgatgctgtgaccccaagagcgctggttatttcggcatataaaaacgttaatgtaagcggattcacagcgattggtgatccagactatgattataaagaaaaccctgtcgtagccttgcaatatcgcagccaaaatataaccattaatggcattaaaattcgcggttttaaaaaagccggtgttgatattaatttatcaggcggatcaaataaaactgattatattaaaatttcaaattttgatatttataactctgctccaaaaggaatttcaatcggtggaggcctctacaatgtcaatattctaaatggaacgatgattactgacaatgggacagttgcaattcagtcccccaataatcaggccacaattctcggtgtacaatcagaaggttatagtgtggcagcctcaatcaaaggccaaacataccaacaagttccaattaatttgaaaggaggcatacagcttgcaacgacctctggctttgccgttaaccaaacaagcgcagttatagcaggtaccggcgacattacggcccgcggagaaagaaatgcggtcattagctcttctggaggctccagtactgaaggctctcgcgcattaatcgcttcttcaaataacgcacatattagaggaaaccaagcgtcaagaacaatactgtcttctgaaaatattatacttgaggaaccatacaccgtggcaggaggtcatcaatcaataaagtggcttcttgactctgttcggggaaacgggacgtttgccggtgcaatcagttcttctttaggtggatatggagagtattttgagagttcaactggacagttaatccatactggtacaatcgtgactttaagaggtgaaaaaattgtgcccgcgaatgttggagattatatgcttggcgttatttcagaaaattcagctttcatttcaggagcctccagtttcgtctggcagggccgttatttgacaaatgagttcggcggatttatttatgaaacggtgactgatgaggaaagcggtgaactcatacgtgttcctaaacaaaatccagactacgatacagcgctggaggcaaattattattcacgggcagcaagagacgaatggcacgttgtagggttggtaggccaacattatgttcgtattgacgaaactgtcaatcaaggagattatcttacggcacataatggaataggaacaaaagccgctgaaggaagctggaaagtaatgaaaataacctctgcttacaaatcagaaaaagggtatggtatcgctctaaccgtcatcaaatag

SEQ ID NO: 176 - DNA, 2403 bp, Bacillus Sp.
atggttcattttaaaaactgccctgatccttctctaaacgccaaatctcaccccgaattagaacatattaagacaagaatgcaaaactttattaagcactccgttacagaccaaaatatcgaagttactgacgcaagggtgacggccgaaggagagattacctctcttttaaaagaacgtctcgacaaggaatactataagcttttatctaaaatcacccgggaagtaaatgtggaagactttggcgctgttccagatggaagagataatactgaggcttttcgaaaagcaatcgggaatggccgagtcaaggtaaacgttccagcaggagaatatcacgtacaagggattaaactcccctcttggacaacaattgttggacaaggtaaagggatcacagtgattaaattacatgaagatactccagcacatgaatgggtgattacaaatgatgattatcaaaatggaaatcgcaatatttttgtccaaggaatgtcattagactggaatccaagcagacaatgtggtgtgagaaacccagggggacagttctccagttgtttgacttttgctaaggttgaatatggatggatcaaagatgtggaagctattaacgcaggtcttcatggcattgatatcacatcgccaacgtatgatcatttgcctaataccgattggacaaaagacggatcaagatatatttggatcgataactgtgtgacatatggttcgggagacgacggcattaccacccattacagtgaatacatctttatttcaaactgccattcaggaaatcctcgaggaacagaatttgcagaaggtgtttcaaactccaacggaatagaaattgacgacggctctaggcatgtgtggcttttaaataactttacaagtggaaacatccgtggagttgaggtaaaagcccatgaactttggccggcctctcaaaacgtccatatcatagggcatgtttcttatcgcgatgttcgtgcgtttgatcttcgtcatattggtcaccaccaaattacagatcctgaaagcacaacagcatacgatgtcacactcattgattgttcagcagttgaaccggtttttaactcgctttatgatgctgtgacaccaagagcattggttatttcagcgtataaaaatgtcaatgtaagcggattcacagcaattggtgatccagactatgattataaaggaaatcctgttgtggctttgcaatatcgcagtcaaaatataactattaatggcataaaaattcgagggtttaaaaaggccggcgttgatattaatttatcaggcggatcaaataaaacagactatattaaaatttcaaatttcgatatttataaatctgcacctaaaggaatttcaatcggtggcggtctctacaatgtgaatattctaaatggaacgatgattactgacaatgggacagttggaatccagtctcccaataatcaggccacaattcttggtgtacagtcagaaggttatggtatagcagcctcaatcaaaggtcaagcataccaacaagttccaatcaatttgaaaggaggcgtacagcttgcgacgacctctggctttgccgtaaaccaaacaagcgcagttatagccggtaccggtgacattatggcccgcggagaaagaaatgcggtcatcagctcttctggaggctccagtactgaaggctctcgcgcattaatcgcttcttcaaataacgcacatcttaaaggaaaccatgcttcaagaacgatactgtcttctgaaaatattatacttgaagaaccatacaccgtcgcaggaggtcatcaatcaatgaaatggcttcttgactctgttgggggaaacgggacgtttgccggggcaatcagttcttctttaggtggatatggagagtattttgagagctcaaatggacagttaatccatacgggtacaatcgtgactttaagaggtgaaaagatagcgcccgcgaatgtgggagattatatgcttggcgttatttcagaaacttcagctttcatttcaggagcctccagtttcgtctggcagggccgttatttgactaatgagtttggcggatttatttatgagacagtgactgataaggaaagcggtgaactcatacaagttcccaaacaaaacccagactacgatacagcacttgagtcaaattatcattcacgggcagcaagagacgagtggcacgtagtagggttagtaggccaacattatgtgcgtattgacgaaactgtcagtcaaggtgactatcttacagcacatcatggaataggaacaaaagccaccgaaggaagctggaaagtaatgaaaataacttctgtttacacatcagaaaaaggatatggtatcgctctaaccgtcattaaatag

SEQ ID NO: 177 - DNA, 2484 bp, Bacillus Sp.
atgctaactccttatctcaaagacaaaactgcgcttatattaaaagaaagaggtgactttagaatggttcattttaaaaactgccctgatccttctctaaacgccaattctcagtctcaccccgaattttcatccgaattagaacatattaagacaagaatgcaaaactttattaagcactcggttacagcccaaaatatcgaagttactgacgcaagggtgacggccgaaggagaggtcacctctcttttaaaagaacgtctcgacaaggaatattataggcttttatctaaaatcacccgggaagtaaatgtggctgacttcggcgctgttccagatggaagagacaatactgaagcttttcgaaaagcaatcgggaatggccgagtcaaagtacatgttccagcgggagaatacctcgttcaagggattaaacttccatcttggacaacaattgttggacaaggtaaagggatcacagtgattaaattgcatgaagacactccagcgcatgaatgggtgattacaaatgatgattatcaaaatggaaatcgcaatatttttgtccaaggaatgtcattagactggaatccaagtagacaatgcggtgtgagaaatccagggggacagttctccagttgtttaacttttgctaaggttgaatatgggtggatcaaagatgtggaagcgattaacgcaggtcttcatggtattgatattacatcgccaacgtatgaccatttgcctgataccgattggacaaaagacggatcaagatatatttggatcgataactgtgtgacatatggttcaggagacgacggcattaccacccattatagcgaatacatctttatttcaaactgccattcaggaaatccgcggggaacagaatttgctgaaggtgtttcaaactccaacggaatagaaattgacgacggctctaggcatgtgtggcttttgaataactttacaagcggcaacatccgcggagttgaagtaaaagcccatgaactgtggccagcctctcaaaacgtccatatcataggccatatttcttatcgcgatgttcgtgcatttgatcttcgtcatattggtcaccatcaaattacagatcctgaaagcacaacagcatacgatgtcacactcattgattgttcagcagttgaaccagttttcaactcgctttacgatgctgtgaccccaagagcgctggttatttcggcatataaaaacgttaatgtaagcggattcacagcgattggtgatccagactatgattataaagaaaaccctgtcgtagccttgcaatatcgcagccaaaatataaccattaatggcattaaaattcgcggttttaaaaaagccggtgttgatattaatttatcaggcggatcaaataaaactgattatattaaaatttcaaattttgatatttataaatctgctccaaaaggaatttcaatcggtggaggcctctacaatgtcaatattctaaatggaacgatgattactgacaatgggacagttgcaattcagtcccccaataatcaggccacaattctcggtgtacaatcagaaggttatagtgtggcagcctcaatcaaaggccaaacataccaacaagttccaatcaatttgaaaggaggcatacagcttgcaacgacctctggctttgccgttaaccaaacaagcgcagttatagcaggtaccggcgacattacggcccgcggagaaagaaatgcggtcattagctcttctggaggctccagtactgaaggctctcgcgcattaatcgcttcttcaaataacgcacatattagaggaaaccaagcgtcaagaacaatactgtcttctgaaaatattatacttgaggaaccatacaccgtggcaggaggtcatcaatcaataaagtggcttcttgactctgttcggggaaacgggacgtttgccggtgcaatcagttcttctttaggtggatatggagagtattttgagagttcaactggacagttaatccatactggtacaatcgtgactttaagaggtgaaaaaattgtgcccgcgaatgttggagattatatgcttggcgttatttcagaaacttcagctttcatttcaggagcctccagtttcgtctggcagggccgttatttgacaaatgagttcggcggatttatttatgaaacggtgactgatgaggaaagcggtgaactcatacgtgttcccaaacaaaatccagactacgatacagcgctggaggcaaattatcattcacgggcagcaagagacgaatggcacgttgtagggttggttggccaacattatgtgcgtattgacgaaactgtcaatcaaggagattatcttacggcacataatggaataggaacaaaagccactgaaggaagctggaaagtaatgaaaataacctctgcttacacatcagaaaaagggtatggtatcgctctaaccgtcatcaaatag

SEQ ID NO: 178 - DNA, 2421 bp, Bacillus Sp.
atggttcattttaaagattgtcccgatccttctctaaacgccaattctcagtctcaccccaaattttcatccgaattagaaactattaagacaagaatgcaaaactttattaagcattccgttacagatcagaatatcgaagttactgacgcgaggatgacggctgaaggagagatcacctctcttttaaaagaacgtcttgacaaggaatactataagcttctatctaagatcacccgggaagtaaatgtggcagacttcggcgctgttccagatggaagagataatacggaagcttttcgaaaagcaattgggaatggtcgcgtcaaagtgaacgttcccgccggagaataccttgttcaagggatcaaacttccatcctggacaacgattgagggacaaggtatagggattactgtaattaaattgcatgaagacactccagcacatgaatgggtgattacaaatgatgattatcaaaacgggaatcgaaatattttcgtccaaggaatgtcgttagactggaatccaaatagacaaggtggtgtgagaaatccggggggacagttctcgagttgtttaacttttgctaaagttgaatatggttggatcaaaaatgtggaagctattaacgcaggtcttcatggtattgatattacatcgccaacgtatgatcatttgcctgataccgattggacaaaagacgggtcaagatttatttggatcgataactgtgtaacgtacggttcaggagatgacggcattaccacccattacagcgaatacatctttatttcaaactgccattcaggaaatccacgaggaactgagtttgcagaaggtgttgcaaactccaacggaatagaaattgatgacggctccaggcatgtgtggctattgaataactttacaagcggaaacattcgtggagtagaagtaaaagctcatgaactgtggccggcctctcaaaatgtccatattataggacatgtttcctatcgagatgtgcgtgcatttgatcttcgtcatattggtcaccatcaaatcacagatcctgaaagcacaacagcatacgatgtcacactcactgattgttcagcaattgagccagttttcaactcgctttatgatgctgtgacgccaagagcactggttatttcggcatataaaaacgtttatgtaaacgggttcacagcggttggcgatccagactatgactataaaggaaatcctgtcatagctttgcaatatcgcagtcaaaatattactattaatggagtaaaaatccgagggtttaagaaagccggcgttgatattaatttatcaggtggagcaaataaaactgattatgttaagatttcaaacttcgatatatatcactctgctccaaaaggaatttctatcggtggcggtctctataatgtgaatatactaaatggtacgatgcttactgacaatgggaccgttggaatccagtcgcccaataatcaggccacaattctcggtgtacagtcagaaggttatagtgtggcagcctccatcaaaggtcaaacgtaccaacagattccaatcaatttaaaaggaggcgtacagcttgcaaccacctctggctttgcctttaaccaaacaagcgcagttattgcaggtactggtgatattacagcccgaggagaaagaaatgctgtcatcagtgcttcaggaggctccagcacagaagggtctcgtgcattaattgcatcttcaaacaatgcacatattaaaggaaataaggtttcaagaacaatactatcttctgaaagtattatactggaagaaccatatactgtggcaggaggtcatcgatcaataaaatggcttcttgactctattgggggaaacggaacatttgccggtgctattagttcttctttaggtggatatggagagtattatgagagttcaactggacagttaattcatacaggtacaattgtgactttaagaggtgaaaagatagcccctgctcatgcgggagattatatgcttggcgttatttcagaaactgcagctttcatttcaggaacatccagttttacctggcagagccgctatttgacaaatgagtttggcggtttgatttacgaggttatgactgatgaagaaaccggtgaactcatacgtgtgcccaaacaaaatccggactacgatactgcgctggagacagattatcattcacgggctgcaagagacgaatggcatgtagtaggattggtaggccagcattatgtgcgtattgacgaaactgtcggtcaaggagattatcttacggcacataatgggataggaacaaaagcaacaaaaggcagctggaaagtaataaaaataacctctgcctactcatcggaaaaaggatatggtatcgctctgaccgtcatcaaatag

SEQ ID NO: 179 - DNA, 2421 bp, Salinibacillus Sp.
atggttcattttaaaaactaccccgatccttctctaaacgccaaatctgagtcacacccggaatatacatctgaaattgaacatgtcaaggagagaatgcaaaaccttattaggcattccgttacagatcaaaacgtcgaagtaactgacgcaaggatgacggcagaaggagagatcacctctcttttaaaagaacgtcttgacagagaataccataagcttttaagtaaaatcacccgggaagtaaatgtggaagacttcggagctgttcccgatggacgagacaatacagaagcttttcgaaaagcaatcggtaatggtcgcgtcaaagtaaatgttcctgccggagaatatctggttcaagggattaaacttccgtcctggacaacaattgcagggcaaggtaaaggaattaccgtaattaaacttcatgaagactctcccgctcatgaatgggtaatcacaaatgatgattaccaaaatgggaaccgcaatatttttgttcaaggaatgtcattagactggaatcctaatagacaatgcggtgtgaaaaatcctggtggtcaattctccagctgtttaacttttgctaaagttgaatatggatggattagagacgtggaagccattaacgcaggtcttcacggcattgatattacatccccaacgtacgatcatttacctgataccgactggactaaagacggctcaaaatatatttggattgataactgtgtggcatatggttcaggagacgacggcattactacccattatagtgaatacatctttatttcaaattgccattccggtaatccgcgaggaacggagtttgcagagggtgtatccaactccaacggaatagaaatcgacgatgggtctaagcatgtatggcttttgaataactttacaagcggaaacattcgtggagtagaggttaaagcgcatgcaatgtggccagcctctcaaaatgtccatatcatcggccatgtttcttatcgtgatgtccgggcatttgatcttcgtcatattggtcatcatcaagccactgatcctgaaagcacaacggcttatgatgtcacactcattgattgttcagcaattgaaccggttttcaactctctttatgaagctgtcacgccaagagcgctagttgtttcagcatataaaaacgttaatgtaagcggattcacagcaattggtgatcccgactatgactataaggaaaatcctgtcgtagctttgcaataccgcagtcagaatatcacccttagcggtattaaaattcgcggatttaaaaaagccggtgttgatattcatttatcaggcgggtcaaataaaactgattatattaaaatttcaaactttgatatttatcaatctgctccaaaaggaatttcaatcggtggcggtctctataatgtgaatatactaaacggtacaatgattgctgataacggagcggtcggaattcagtcgcctaataatcaaaccgtcattctcggtgtacatgcagaaggttatagtgcggcggtcaccatcaaaggtcaatcataccagcatgtacccattaatttaaaaggcggcgcacagcttgcaacaacctctggcttcgcctttaaccaaacgagcgcagttatcgctggtaccggagacattacggcgaagggagaaagaaatgcggtcatcggcgcttcaggaggctctagcacagaaggctcccgtgcattaatcgcttcttcaaacaatgcccatattaaaggaaacaatgtttcaaggacaattttgtcttctgaaagtattatactggaagaaccatacaccgtggcaggaggccatcaatcaatgaaatggcttcttgactcagttggaggaaacgggacatttgcaggagcaatcagttcttccttaaatggatatggagagtattttgagagttcaactgggcagttaatccagacaggtacaatcgtcactttaagaggtgaaaaaatagcgcccgcccacgtgggagattatatgcttggagttatttcggaaacagcagctttcatttcaggagcatccagcttcgtctggcaggaccgctatatgactaatgagtttggcggattcatttatgaggatctgatcgacaaggaaaccggtgaattgatacgtgtgccaaaacaaaatccagactatgatgcagcgctggagaccgcttatcattcacgggctgtaagggacgaatggcatgtggttggactggcgggacagcattatgtacgtattgacgaaactgtgggacaaggagactaccttactgcgcataatgggataggaacaaaagcatctgaaggaacctggaaagtaatgaaaatcactaccatttacactccggaaaaagggtacggcatcgcactcaccgtcattagatag

SEQ ID NO: 180 - DNA, 2421 bp, Bacillus Sp.
atggttcattatcaaaactatcctgatccgtctctaaacgccaaattgcagtctcaccctgagcattcatctgaaatagaacatctcaaagcaaggatgcaaaatttcattaagcattccgttactgaacaaaacattgaggttacggatgcaagggtgacggcggaaggagaggtcacctcacttttaaaagaacggctcgacaaagaataccataaacttttgtgtaaaatcacccgggaagtaaatgtcgaagatttcggcgctgtcccagatggaagggacaatacggaagcttttcgcaaagccatcggcaatggacgcgtcaaagtgaacgttcctgccggagaatttctggttcaggggattaagcttccatcctggacaactattgtcgggcaaggcaaaggcatcaccgtgataaaactgcatgaagacacccctgcacatgaatgggtgatcactaatgatgattatcaaaatggaaaccgtaatatttttgtccaaggaatgtcattagactggaatccggatagacaatgcggagtgagaaaccctgggggacagttctccagctgtttaacatttgccaaagttgaatatggctggatgaaagatgttgaagccattaatgcgggtcttcatgtcattgatattacatcaccgacatacgatcattcccctgataccgactggacaaaagacggctcaaaatatatttggatcgataactgtgtggcttatggcgcaggagatgacggcattaccacccattacagcgaatacatctttatttcaaactgccattccggaaatccgcgcggtacagaacacgctgaaggtatttcaaactctaacggaatagagatcgatgatggctccaagcatgtgtggcttttgaataactttacaagcggaaacatccgcggagtagaggtcaaggcccatgcgatgtggccggcctctcaaaatgtccatatcatcggccatgtttcttatcgtgatgtccgcgcttttgatcttcgccatatcggccatcaccaagcaacagatccggaaagcaccacagcttacgatgttacactcatcgactgctcagcaattgaaccggttttcaattcgctatatgaaggagtgaccccaagagcactggttgtttcagcatataaaaacgtaaatgtaagcgggttcacagctattggcgatcccgactatgactatggcggaaatcctgttgtggccatgcaataccgcagtcaaaatattgcaattaacggcattaaaattcgaggatttaaaaaagccggcgttgatattaatttatcaggcggaacgaataaaaccgattatattaaaatttcaaacttcgatatttatcattccgctccaaaaggaatctcgatcggcggcggcctctataatgtgaacatcatgaacggaacgatgatttcagatagcgggacggtcggaatccagtcgcccaataatcaggccgtcattctcggcgtgcaggcagaaggatatagtgcggcggtctccatcaaaggccaaacataccagcatgtaccggtcaatttaaagggaggcgcacagcttgcaacgacctccggctttgcgtttaatcaaacaagcgccgttatcgcgggtaccggtgaaattacggcaaaaggagaaagaaatgcggtcatcggcgcttcaggaggctccagtacagaaggctcccgcgcattaatcgcagcttcaaacaacgcccatattaaaggaaacaatgtgtccagaacgatattgtcttctgaaagtattacactggaagaaccctacaccgtagcgggaggccaccaatcaatgaaatggcttcttgactctgtaggaggaaacggaacatttgcgggagcgatcagttcttccctaagaggatacggagagtattttgagagttcaaccgggcagttaatcaatacaggcaccatcgtgactttaaggggcgataaaatcgcgccggcccatgtgggagattatatgcttggagtgatttcggaaacggcaggtctcgtatcaggagcatcaagcttcatctggcagggccgctatttgactaacgaatttggcggcttgatttatgaggatgtgactgatgaggaaaccggagaactgattcgcatgccgaaaaaaaatccggactatgatgccgcattggaagctgattatctttcacggtcagcaagagatgaatggcatgttgtcggacttgtgggccagcattatgtgcgtattgacgaaacggtcagtcaaggagattatcttacggcccataatgggatcgggacaagagcatctgaaggagattggaaggtcatgaaaataaccgcctcttacattcctgaaaaaggatatggcatcgctctcgacgtgatcagatag

SEQ ID NO: 181 - DNA, 2421 bp, Bacillus Sp.
atggttcaatttaaaaactatcctgatccgtctttaaacgccaaaatgcagtctcacccagagcattcttctgaatttgaacatctcaaggcaaggatgcagaattttattaagcattctgttaccgatcaaaatcttgagatcgcggatgcacgggtgacggcggaaggagtggtcacctcacttttaaaagaacggcttgataaagaatacgataagctgatgagtaaaatcacccgtgaagtcaatgttgaagatttcggagctgttcctgacggcagggacaataccgaagcttttcagaaagccatcggaaatgggcgtgtcaaagtgaacgttcccgccggtgaatttttggttcaggggattaaacttccgtcctggacaacgatttccggacaaggcaaaggcattactactattaaacttcatgaagatgcccccgcatatgaatgggtcatcacaaatgatgattatcaaaatggaaaccgcaatatttttgtccaggggatgtcattagattggaacccggatagacaatgcggtgtcagaaaccccggaggacagttttccagctgtttaacgtttgccaaagttgaatatggctggattaaagatgtcgaagtcattaacgcaggtcttcacggcattgatattacttcgccgacatacgaccatttgcctgataccgactggacaaaagacggctgccgttatatatggattgataactgtgtggcatacggggcaggtgacgatggcattaccacccattacagtgaatacatctttatttctaactgccactccggaaacccgcgcggcacagagcacgctgaaggcagtgcaaactctaacgggattgaagttgacgacggttctaaacatgtatggctattgaataactatacgagcggaaacatccgcggagtagaagtcaaagctcacagtctatggccggcctctcaaaacgttcatatcatcggccatgtttcctatcgtgatgttcgcgcatatgatattcggcatatcggccatcaccaagcctcagaccctgaaagcaccacagcttacgatgttacactcaccgattgctcggcgattgaaccggtcttcaactctttatacgagagcgtgacaccgagagcattggtgatttcagcatataaaaacgtcaatataagcgggttcacagccattggcgatcccgcatatgactatggcggaaaccctgtcgtagccctgcagtaccgcagtcaaaatattacgattaacggcattaaaattcgcggatttaaacaggcgggcgtcgatattaatttatcgggcggatcgaacaagaccgattatgttaaaatttccaactttgatatttatcaatcctcccctaaaggaatttcgatcggcggcggtctttatcatgtgaatattataaacggaacgatgatcggagacggaggttctgtcggaatccaaacccctaacagtcaggcggtcattctcggagtgcatgcagaaggctacagcgctgcggcatctattaaaggccaaacttacgagcaaattccggtcaatttaaagggaggcgcccagcttgcgacgagctccggatttgcgttcgacccaacaagcgccgtaatcgcaggtaccggagacattatggcgaaaggagaaagaaatgcgattatcagcgcctcaggaggttccagtacggaaggttccagagccttaatcgccgcttcaaacaacgcacacattacaggcagcaacgtatccagaacgattctgtcatctgaaagcataacattggaagagccgtatacagtagccggaggccatcagtccatcaaatggaaactcgactctgccggaggaaacggaacatttgccggagcaatcacctcctccttaacaggctacggagagtattttgagagttcaaccgggcaggtaatccctgccggaacgatcgtcacggtaaggggcgaaaaaatcgaaccggctcacgtcggagactatatgcttggagtaatttcagaaacggcggcttttgtgtcaggcgcatccagctttgtctggcagggccgctatttaacaaacgagtttggcggcttcatatatgaaaatgtgactgatgaggaaaccggtgaaacgatacgcatgccaaaacaaaatccggactacgacccggcgcttgaggccgattatcattcacgtgctctaagagacgaatggcacgtcgtcgggcttgtcgggcggcattatgtgcggatcgaccaaacggtcagtcaaggagattatattacggcccataatgggatcgggacaaaagcagccgaaggagactggaaagtgatgaaaataactgccttatacactcctgaaaaaggatacggcattgctcttgcggttatcagataa

SEQ ID NO: 182 - DNA, 2421 bp, Bacillus Sp.
atggttcaatttaaaaactatcctgatccgtctttaaacgccaaaatgcagtctcacccagagcattcttctgaatttgaacatctcaaggcaaggatgcagaattttattaagcattctgttaccgatcaaaatcttgagatcgcggatgcacgggtgacggcggaaggagtggtcacctcacttttaaaagaacggcttgataaagaatacgataagctgatgagtaaaatcacccgtgaagtcaatgttgaagatttcggagctgttcctgacggcagggacaataccgaagcttttcagaaagccatcggaaatgggcgtgtcaaagtgaacgttcccgccggtgaatttttggttcaggggattaaacttccgtcctggacaacgatttccggacaaggcaaaggcattactactattaaacttcatgaagatgcccccgcatatgaatgggtcatcacaaatgatgattatcaaaatggaaaccgcaatatttttgtccaggggatgtcattagattggaacccggatagacaatgcggtgtcagaaaccccggaggacagttttccagctgtttaacgtttgccaaagttgaatatggctggattaaagatgtcgaagtcattaacgcaggtcttcacggcattgatattacttcgccgacatacgaccatttgcctgataccgactggacaaaagacggctgccgttatatatggattgataactgtgtggcatacggggcaggtgacgatggcattaccacccattacagtgaatacatctttatttctaactgctactccggaaacccgcgcggcacagagcacgctgaaggcagtgcaaactctaacgggattgaagttgacgacggttctaaacatgtatggctattgaataactatacgagcggaaacatccgcggagtagaagtcaaagctcacagtctatggccggcctctcaaaacgttcatatcatcggccatgtttcctatcgtgatgttcgcgcatatgatattcggcatatcggccatcaccaagcctcagaccctgaaagcaccacagcttacgatgttacactcaccgattgctcggcgattgaaccggtcttcaactctttatacgagagcgtgacaccgagagcattggtgatttcagcatataaaaatgtcaatataagcgggttcacagccattggcgatcccgcatatgactatggcggaaaccctgtcgtagccctgcagtaccgcagtcaaaatattacgattaacggcattaaaattcgcggatttaaacaggcgggcgtcgatattaatttatcgggcggatcgaacaagaccgattatgttaaaatttccaactttgatatttatcaatcctcccctaaaggaatttcgatcggcggcggtctttatcatgtgaatattataaacggaacgatgatcggagacggaggttctgtcggaatccaaacccctaacagtcaggcggtcattctcggagtgcatgcagaaggctacagcgctgcggcatctattaaaggccaaacttacgagcaaattccggtcaatttaaagggaggcgcccagcttgcgacgagctccggatttgcgttcgacccaacaagcgccgtaatcgcaggtaccggagacattatggcgaaaggagaaagaaatgcgattatcagcgcctcaggaggttccagtacggaaggttccagagccttaatcgccgcttcaaacaacgcacacattacaggcagcaacgtatccagaacgattctgtcatctgaaagcataacattggaagagccgtatacagtagccggaggccatcagtccatcaaatggaaactcgactctgccggaggaaacggaacatttgccggagcaatcacctcctccttaacaggctacggagagtattttgagagttcaaccgggcaggtaatccctgccggaacgatcgtcacggtaaggggcgaaaaaatcgaaccggctcacgtcggagactatatgcttggagtaatttcagaaacggcggcttttgtgtcaggcgcatccagctttgtctggcagggccgctatttaacaaacgagtttggcggcttcatatatgaaaatgtgactgatgaggaaaccggtgaaacgatacgcatgccaaaacaaaatccggactacgacccggcgcttgaggccgattatcattcacgtgctctaagagacgaatggcacgtcgtcgggcttgtcgggcggcattatgtgcggatcgaccaaacggtcagtcaaggagattatattacggcccataatgggatcgggacaaaagcagccgaaggagactggaaagtgatgaaaataactgccttatacactcctgaaaaaggatacggcattgctcttgcggttatcagataa

SEQ ID NO: 183 - DNA, 2517 bp, Bacillus Sp.
ttgataaagaatttgaaggataagcgcaaaaggaggcaggcggcctgctttgccttcaaatcagcgcttatatcaaaagaaagaggtgtctttagaatggttcattatcaaaactatcctgatccgtctctaaacgccaaattgcagtctcaccctgagcattcatctgaaatagaacatctcaaagcaaggatgcaaaatttcattaaacattccattactgaacaaaacattgaggttacggatgcaagggtgacggcggaaggagaggtcacctcacttttaaaagaacggctcgataaagaataccataaacttttgtgtaaaatcacccgggaagtaaatgtcgaagatttcggcgctgtcccagatggaagggacaatacggaagcttttcgcaaagctatcggcaatggacgcgtcaaagtgaacgttcctgccggagaatttctggttcaggggattaagcttccatcctggacaactattgtcgggcaaggcaaaggcatcaccgtgattaaactgcatgaagacacccccgcacatgaatgggtgatcactaatgatgattatcaaaatgggaaccgtaatatttttgtccaaggaatgtcattagactggaatccggatagacaatgcggagtgagaaaccctgggggacagttctccagctgtttaacatttgccaaagttgaatatggctggatcaaagatgttgaagccattaatgcgggtcttcatggcattgatattacatcgccgacatacgatcattcgcctgataccgaatggacaaaagacggctcaaaatatatttggatcgataactgtgttgcttatggcgcaggagatgacggcattaccacccattacagcgaatacatctttatttcaaactgccattccggaaatccgcgcggtacagaacacgctgaaggtatttcaaactctaacggaatagagatcgacgatggctccaagcatgtgtggcttttgaataactttacaagcggaaatatccgcggagtagaggtcaaggcgcatgcgttatggccggcctctcaaaatgtccatatcatcggccatgtttcttatcgtgatgtccgcgcttttgatcttcgccatatcggccatcaccaagcaacagatccggaaagcaccacagcttacgatgtcacactcatcgactgctcagcaattgaaccggttttcaattcgctatatgaaggagtaaccccaagagcactggttgtttcagcatataagaacgtaaatgtaagcgagttcacagctattggcgatcccgactatgactatggcggaaatcctgttgtggccatgcaataccgcagtcaaaatattgcaattaacggcattaaaattcggggatttaaaaaagccggcgttgatattaatttatcaggcggaacgaataaaaccgattatattaaaatttcaaactttgatctttatcattccgctccaaaaggaatctcgatcggcggcggcctctataatgtgaacatcatgaacggaacgatgattgcagatagcgggacggtcggaatccagtcgcccaataatcaggccgtcattctcggcgtgcaggcagaaggatatagtgcggcggtctccatcaaaggccaaacataccagcatgtaccggtcaatttaaagggaggcgcacagcttgcaacgacctccggctttgcgtttaatcaaacaagcgccgttatcgcgggtaccggtgaaattacggcaaaaggagaaagaaatgcggtcatcggcgcttcaggaggctccagtacagaaggctcccgcgcattaattgcagcttcaaacaacgcccatattaaaggaaacaatgtgtccagaacgatattgtcttctgaaagtattacactggaagaaccctacaccgtagcgggaggccaccaatcaatgaaatggcttcttgactctgtaggaggaaacggaacatttgcgggagcgatcagctcttccctaagaggatatggagagtattttgaaagttcaaccgggcagttaatcaatacaggcaccatcgtgactttaagaggcgaaaaaatcgcgccggcccatgtgggagattatatgcttggagtgatttcggaaacggcgggtctcgtatcaggagcatcaagcttcatctggcagggccgctatttgacaaacgaatttggcggcttgatttatgaggatgtgactgatgaggaaaccggagaactgattcgcatgccgaaaaaaaatccggactatgatgccgcattggaagctgattatctttcacggtcagcaagagatgaatggcatgttgtcggccttgtgggccagcattatgtgcgtattgacgaaacggtcagtcaaggagattatcttacggcccataatgggatcgggacaagagcatctgaaggagattggaaggtcatgaaaataaccgcctcttacattcctgaaaaaggatatggcatcgctctcgccgtgatcagatag

SEQ ID NO: 184 - DNA, 2418 bp, Bacillus Sp.
atggttcaatttaaaaactttcctgatccgtctttaaacgccccattgcagtctcgccctgcacagccctctgaattggagcatctcaaagcaaggatgcagaattttattaagcattccgcaacggatgataatcttgagatcgcagatgcccgggtgacggcggaaggaatggtcacctcacttttaaaagaacggcttgatacagaatacgaaatgcttatgaataaaatcacccgggaagtgaatgtggaggactacggagcggtccctgacggccgggacaatacagaagcttttcggagagcgatcgggaacggccgggtcaaagtaaatgttcccgcaggagaatttttggttcaagggataaaactcccctcatggactaccatttccggtgagggacaagggattaccgtgcttaagcttcatgaggacactcccgcattcgaatgggtcattactaacgatgattacgaaaatggaaaccgtaatatttttgtggaaaacatgactttagactggaatcctgatcgtcaatgcggggtcaggaaccccggaggacagttttccagctgtttaacgtttgctaatgtgcaatacggctggattaagaatgttgaaacggttaacgcgggtctccatggtattgatattacatctccgacttacgatcatttgcctgaaacagaatggacgaaagacggctgccgatatatatggattgataactgtgtggcatacggcgccggagacgacggcattaccacccattacagcgagtatattttcatctccaactgccattccggaaacccccgcggcacagagcatgctgagggcagcgcaaactcgaacggcattgaaattgacgacggctctaaacatgtatggcttttaaataactatacgagcggaaatatccgcgggattgaggtaaaggcgcacagcctgtggccggcttctcaaaatgttcatattatcggtcatgtttcgtatcgtgatgtacgttcatttgatattcgtcatatcggccatcatcaggcctcagaccccgaaagcacgacggcttatgatgttactttaaccgattgcaccgcgattgaaccggtattcaatgctctctatgacggtgtgaccccgagggcgctggtcatctctgcctataaaaacgttaatgtaaacggattcacagctattggtgatccctcatacgactatggcgggaatccagtagtggctcttcaataccgcagtcaaaatatcacgatcaacggcattaaaatacgcggctttacacaagcaggtgttgacatcaatatatccggcggatcaaataaaaccgattatgttaaaattttaaattttgatatatacaagtcatctcctaaaggcatctcaatcggcggaggccaatataacgtaaatattatgaacggtacgatgatcggagacggcggttccgtcggaattacgtcccctaacagtcaggccgtcattctcggggtgcaagcggaaggttacagcgcggccgcatctataaaaggacagacttatgagcagatccccgtcaatttaaagggaggcgcacagctcgcgaccagctccggttttgcattcaacccgacaagcgccgttattgcgggaacaggcgatattacagccagaggtgacagaaatgcgatcatcagctcttccggaggttcaagttctgaaggttcaagggcatttatcgccgcttcaaacaatgtccatattacgggcagcaaagtctccagaacgattctgtcatcagaaagcattacattggaagaaccatacacggttgccggagggcatcagtccatcaaatggaaattggattcagcgggcggccacggtacgttcgccggagctgtcacctcttccctgtcagggtacggagaatattttgaaagtgtaaccggccagacaattcccgccgggacaatcgtcacagtgaaaggcgaaaaaattgaatcggctcacgtcggagattacatgctcggcgtcatttcagaaacagccgcttttatctcaggagccgcaagcttcggatggcaaagccgctttttgacaaacgagttcggcggtttcatatacgaaaatgtgactgacgaggaaacaggagaaacggtacgcgtgccgaaacaaaacccagactgcagtccggctcttgaagctgactatgaagcacgagcggccagagacgaatggcacattgtcggactcaacggccggcattacgtacgggtcgacagtacggtcagcccgggagattatatcacggctcataacggaatcgggactaaagccgcggaaggctggaaggtattgaaactgacagccttatacagttctgaaaaagggtacggcattgcaattgcggttatcaaatag

SEQ ID NO: 185 - DNA, 2418 bp, Streptococcus Sp.
atggttcaatttaaaaactttcctgatccgtctttaaacgccccattgcagtctcgccctgcacagccctctgaattggagcatctcaaagcaaggatgcagaattttattaagcattccgcaacggatgataatcttgagatcgcagatgcccgggtgacggcggaaggaatggtcacctcacttttaaaagaacggcttgatacagaatacgaaatgcttatgaataaaatcacccgggaagtgaatgtggaggattacggagcggtccctgacggccgggacaatacagaagcctttcggaatgcgatcgggaacggccgggtcaaagtaaatgttcccgcaggagaatttttggttcaagggataaaactcccctcatggactactatttccggtgagggacaagggattaccgtgcttaagcttcatgaggacactcccgcatacgaatgggtcattactaacgatgattacgaaaatggaaaccgtaatatttttgtccagaacgtgactttagactggaatcctgaccgtcaatgcggagtcaggaaccccggaggacagttttccagctgtttaacgtttgctaatgtgcaatacggctggattaagaatgttgaaacggttaacgcgggtctgcatggtatagatattacatctccgacttacgatcatttgcctgaaacagaatggacgaaagacggctgccgttatatatggattgataactgtgtggcatacggcgccggagacgacggcattaccacccattacagcgaatatattttcatttccaactgccattccggaaacccccgcggcacagagcatgctgagggcagcgcaaactcgaacggcattgaaattgacgacggctctaaacatgtgtggcttttaaataactatacgagcggaaatatccgcgggattgaggtaaaggcgcacagcctgtggccggcttctcaaaatgttcatattatcggtcatgtttcgtatcgtgatgtacgttcatttgatattcgtcatatcggccatcatcaggcctcagaccccgaaagcacgacggcttatgatgttactttaaccgattgcaccgcgattgaaccggtattcaatgccctctatgacggtgtaaccccgagggcgctggtcatctctgcctataaaaacgttaatgtaaacggattcacagctattggtgatccctcatacgactatggcgggaatccagtcgtggctcttcaataccgcagtcaaaatattacgatgaacggcattaaaatacgcggctttacacaagccggggttgacatcaatatatccggcggatctaataaaaccgattatgttaaaattttaaattttgatatatacaagtcttctcctaaaggcatcacaatcggcggaggccaatataacgtaaatattatgaacggtacgatgatcggagacggcggttccgtcggaattacgtcccctaacagtcaggctgtcattctcggggtgcaagctgaaggttacagcgcggccgcatctataaaaggacagacttatgagcagatccccgtcaatttaaagggaggcgcacagctcgcgaccagctccggttttgcattcaacccgacaagcgccgttattgcgggaacaggcgatattacggccagaggtgacagaaatgcgatcatcagctcttccggaggttcaagttccgaaggttcaagggcatttatcgccgcttcaaacaatgtccatattacgggcggcaaagtctccagaacgattctgtcatcagaaagcattacattggaagaaccatacacggttgccggagggcatcagtccatcaaatggaaactggattcagcgggcggccacggtacgttcgccggagctgtcacctcttccctgtcagggtacggagaatattttgaaagtgtaaccggccagacaattcccgccgggacgatcgtcacagtgaaaggcgaaaaaattgaatcggctcacgtcggtgattatatgctcggcgtcatttcagaaacagccgcttttatctcaggagccgcaagcttcggatggcaaagccgctttttgacaaatgagttcggcggtttcatatacgaaaatgtgactgacgaagaaacaggagaaacggtacgcgtaccgaaacaaaacccggactgcagtccggctcttgaagctgactatgaagcacgcgcggccagagacgaatggcacattgtcggactcaacggccggcattacgtacgagtcgacagtacggtcagcccgggagattatatcacggctcataacggaatcgggactaaagccgcggaaggctggaaggtattgaaactgacggccttatacagcgctgaaaaagggtacggcattgcaattgcggttatcaaatag

SEQ ID NO: 186 - DNA, 2445 bp, Bacillus Sp.
atggttcattcacaaaaaccttctgatgtgtctctaaatgccgaattgagatccaccgctaaaggtcaatttttaaagcatcaaaaccgtttgacggaaatcgagcaactgaaagcaaggatgcaaaatctcattcagcatgtcgaaacctctcaaagcgttgaggtgacagatgcaagggtgacggccgaaggagaggcggcctcactgttgaaggagcggcttgataaggagtatcacaaattgcttggcaaaatcactcgcgaagtgaatgttgcagatttcggggctgttcctgatggaagggataatactgaagctttccgcaatgcgatcggaaatggacgagttaaagtgaacattccggcgggcgaatattttgttcaaggaatcaagcttccgtcttggacatatcttgtcggacaaggcaaaggcgtcactgtcattaaacttcatgaggataccccggcacatgagtgggtcatcacgaatgacgattatgaaaatggaaaccgtcatatttttgtccagggaatgactttagactggaatcctgacagacaatgcggggtgagaaatcctggagggcagttttccagctgtttaacgtttgcaaaagtcgaatttggctggatcaaagatattgaagccgtcaatgcaggtctccacggaattgatattacatccccgacatatgatcatttgcctgatacagactggacaaaagacggctccaaatatatttggattgataactgtgtcgcatatggcgccggcgatgacggcatcactacgcattacagcgaatacatctttatttcaaactgctattctgcagcccctcgcggcacagagcacgccgaaggcatggccaactccaacggtatcgagattgatgatgggtcaaagcatgtctggcttttaaacaacgtgacaagcggaaacattcgcggggtagaagtgaaagcccatgaaatgtggccggcttctcaaaatgtccatattatcggccatatatcctaccgggatgtccgcgcgtttgaccttcggcatatcggccaccaccaggcatcagatccggaaagcaccacagcatacgatgtaacgcttattgattgtacagcggtcgagccagtcttcaattctctgtatgagagtgtgaccccaagagcactcgttgtttcagcctataaaaatgtttatataagcggattcacagcgatcggaaatccggattacgactatggcggctatcctgtagtagcattgcagtaccgaagtcaaaacattacgatcaatgggattaagattcgcggatttaaaaaggccggcatcgatattcgtttattgggaggggcaaatcaaaccgatcatatcaaaatatcaaactttgatttttatcattcagctccaatcggaatatcgatcggaggcggactctataacgtgaatattatgaacggaaccatgataacagaaggcgggacagcagggatccagtctccgaatagtcaggctgtcatcatcggcgttttggcggaagggtacagcgccgctgcatccattaaaggtcaaacctaccagcagatgcccgtcaatttaaagggcggagcccagattgcaaccacctccggttttgcatttaatcaaacaagcgccgttattgccggaaccggggatattacggcaaaaggtgaaagaaatgcggtcatcggagcttcgggcggttccagcacagagggctcccgcgcatttgtcacagcttcaaacaactctcatattacaggcaacggcgtatccagaacgatactttcatcagaaagcattacacttgaagagccgtacactgtggccggaggtcaccagtcaatcaaatggctccttgactcccgttatggaaatggagcatttgcgggggcggtaacctcttcattaaccggctatggagagtattttgagagtgaaagcgggcagttgatcgatacaggcaccatcgtcactttaaaaggagaaaaaatagcccctgcccaaagcggaaatgatttgctgggggttgtgtcagaaacgacagcttttgtttctggggcatccagctttgtctggcagcgccgctatttgacaaatgagttcggcggattgattgatgaagaggtaaccgatcatgagacaggggagctgattcgcctcccgaaacaaaatccggactataacgagtctttggaagggagctatctgtcacgcgatgtcagagatgaatggcatgtcgtcgggcttttgggcagacagtatgtacgtattgacggcacagtgcggcaaggagattatttaggagcgattgacggcatagggacaaaagcaactgaaggttcttggaaggtgatcaaaataacttctccgtacactcctgaaaaaggatacggaatcgctctcgccttgatcaaatag

SEQ ID NO: 187 - DNA, 801 bp, Kitasatospora Sp.
gtgatcaacattcgaatccgcacggccgccggcgcggtcgccctcgcctgcgccgtcgtgctcacccccgagagcctggccgccgccgcccccgcggcccaggccgacgccgccccgttcagctgtctcgaccccagcggggaggcgctctggagcggcccccagtgcgacggcgtcatcgtccacgaactcggcaccgaggccgtcgccatcgtcctggacggccggcgcatcgacttcgccgacgaggccgaactgcgtgccgacgactgcgccgaccggcccgccgtcaccctccccgccagcaccttcgagagcatcccggagggcccggacccgctgtacgccgccgtggaccgccgggtggacgtaccccggatcacccccacgccgcactggcgcaagaactgccacccgctcttccgctcggacggccgcgacccgtccgtcatcttcgagcagggcttcgcgccgaaggacaccgtcaacggccagtacgacatcaccagttacgtcctgcagaaccagccctcgccgttcgtcagcaccacctacgaccccgagctgtacaagaagtggaagaaggtgccctgggactacttcatcgacgcccccggcggcatcgacgtcaacgcgaccatcggcgaccagcaccagtacgccgaccaggtggaggtcgcgttccccggcggcgtggaccggcacttcatcagccgggcctgcccggtcgaccgggccaccgcctccctggtcgagtccggctgcgtggacaacccgaactaccagccctggctgcactga

SEQ ID NO: 188 - DNA, 3216 bp, Stenotrophomonas Sp.
atgatgcacgttgcaacacggaacaccttgcagtcccgacttcttcttctgccgctgctttccctgccgatgacattggcaaccgcggcaaacaccctcgaaaccgttcaagtcaccgccacgctccccgttggaggtggcggtgcaggcggttttggatttggcggcggcagtggtgtccacctgtccgagtcacagatggacaatggcggtggcggcggtgcaattccgaccgaaacggcgaaggaacagccgaccgatgacaaggagaaggactgcaatggccgcaagggcaatcctgtcgtgctctacagcggcaacaaggtcgagccggaactcgatttcgccagccagggcgaaatgggcctgttcctgcagcggaactacaatcattactggagcgcgaccggcctgttcggcaatcactggctgagcaacttcgactattcgctcgcgttcaccgatgcaaaccagctggcgtgggtacaacggcccgacggtcgccgcatcaagtatctcaaggatccagccagcggccgctggtacgaggacaaggcccagcccatcgcgtatctcgccgcgaacggagacggcacgttcacgcttcgaaacgaaaacaacgggacggaaatctacaacgccgagggctacatcacccggctcagcaatgagcaaggtgtgagctggacgttctcctataccgatcactacctgcagaaggtcacccactcctcgggacgcagtatcagctttggctggaccaatggacaggtctcccaggtgaccgacccggccggcaacatctaccgctacacctatacccccaacgtgttcgggaatgggcgtggtcggctcgccagcacgacattgccaagcgctcctgcaacgacgatcagctaccactacgaagacggccgcttcccgggtgccctgaccggcaagtccttggacggcgtgcgctattccacgtttgcctacgacgcggagcggcgcgccatcagcaccgagcacaatggcggcatcgaacgattccgcttcagctacgccgtgcgcagcaccgaaccggtgcttccgccccccgcccccgctcgaccgggcggtgtccgcgccgacgaagagcgtggatggtgcgagcagcgccccggaggctcacgcatctgctaccagccgcgctcgctgcctgtcgattcgctgccgatggagagcgctctcggcatgaccgccgccgctgcgccgagccttacgcggcccgtcgatatcgatgtcactgtgatcaaccctcttggccgcagcaccacctacacgttcaaggacggaaagattgtgtcgaccaagggtgatccgtcgccgaactgccctgccagctacaaggagcagagctacgacgccaatgggtaccctgatctggtccatgatttccaggacaatctgaccaacttcgactacagcgcacagggctacctgctgaagcgggtggaagcggtcggcagcacggccgaacgtacgacgttgcaggagtgggataccgcgcgtaaccggctgctcaagaccacggtggtgggtgatcttgaagtcgcctacacctatgacgatcgcggaaacgtagccagcgtgactgagcgcaatctgacggcacgtggggtgcccagccagacgcgggtaacccgcaccacctatagctatcacgccaatggattgaaggcctcgatcaagatcgatggcccgcttccgcaggatgacgtcacctcgaccttcaacaaccagggcgatctgaccagcaccaccaacgctctcggtcatacgatcagctattccaacttcaacggcttgggattgccgggacgtatcgtcaatgcgaacggtggtgtgcgggagctgacgtatgacggtcgtggccgcgttgtgtccgacagaaccagctcgggaaccggctgggcgaccacagccattggctacacctccgcaggcgacatcgcctcgctcacccagcccgatggcgtgacggtacgctacggctacgatgcaggacgccgcctgacgcatgaagtccgctcgctgggagacggtacgtgggcgtggacccgtcatagctacaacaacgcttccaatcgcacgcgtaccgaggtttcacagaccgactatccgatcgatacggcagttaagggaatgattgacgaaatcacccatgacgggcagtggaactggttcgctcgaggctgggcctgctccaccggatcggccggatccatccaggtggatggctacgccgaaggcaacgtctacctgggaagcacccaggcaaacctcgccagcgagccaggggttgctgccgcctgccaagcctcaggcaatggctacagataccagctgccgatatcgctggcccagaggcagcagctgggtggccgcaagttctccatctacggtgtatctccgaagggagcacagcacaaccaagcgctgggcaactccggcaacttcgccattccaacggcaacgatcatcggagacgtcgcaggggttacgaacgacgcgaactggaacttctccgtacaaggatgggcatgctccgtgggcgtcaacgcggccaccaccgtacacatctatgcgggagggccggcaggcgctggtacgtatcttgggagcgttaccggcacgctggttccgaacgatgacgtaaaggccgcatgccaatcgcaaggggcgtattggtttggcttcacgttggactccaatatgcgcaacgcacatggcggaaagcccatctacgtccacggcatctcgcactcgggccaggctcatctgctgctcaatcgctcgggtacgttcacagttcccgcggtagtgcgcaacgccgaagtcgttggcgcgtcggcctatccgtaccagatcttcaatggcggctcctcaacattgatcttcgagttccgcaacacaagcaatgtggtctggaatccaggcgatacctacctcgcgttcggcctcaatcagcccaacgaaaacatcgcactctccgcgccggtgccacccggtggcgtggccaggttcagccgcagcgttgggccgaataatccgggcagcgggaatcgaacgttctcgtacgtggcgagaatggcgtccggcggcgttgcctggggcgctgaagcaaaggtcttcctgtcggttgagaacaacaagggaagctgtggtcgcatcacctgcgaacggcctcggtaa

SEQ ID NO: 189 - DNA, 3222 bp, Stenotrophomonas Sp.
atgatgcactttgctacacggaacattctgaagtccccactccttctgctgccattcctttcgttgcccatgaccccggcgactgcagcaagcactgagggaaccgtatacgtcaccaagaagcggctgcctggaactggcggtggtggcgtgggtggctttggattcggtggtggtagtgaaatccatctgtccgaagcacagatggataacggtggtggtggtggcgcaatccccacggaaaccgccaaggagcagccgaccgacgacaaggagaaggactgcaatggccgcaagggcaatcctgtcgtgctctacagcggcaacaaggtcgagccggaactcgatttcgccagccagggcgaaatgggcttgttcctgcagcgcaactacaatcattactggagcgcgaccggcctgttcggcaatcactggctgagcaacttcgactattcgctcgcgttcaccgatgcaaaccagctggcgtgggtacaacggcccgacggtcgccgcatcaagtatctcaaggatccagccagcgggcgctggtacgaggacaaggcccagcccatcgcgtatctcgccgcgaacggagacggcacgttcacgcttcgaaacgaaaacaacgggacggaaatctacaacgccgagggctacatcacccggctcagcaatgagcaaggtgtgagctggacgttctcctataccgatcgctacctgcagaaggtcacccactcctcgggacgcagtatcagctttggctggaccaatggacaggtctcccaggtgaccgacccggccggcaacatctaccgctacacctatacccccaacgtgttcgggaacgggcgtggccggctcgccagtgcgacgctaccaggcacacctgcaacgacgatcagctaccactacgaagatgcccgcttcccgggtgccctgaccggcaagtcctttgacggcgtgcgctattccacgtttgcctacgacgcggagcggcgcgccatcagcaccgagcacaatggcggcatcgaacgattccgcttcagctacgccgtgcgcagcaccgaaccggtgcttccgccccccgccccggctcgaccgggcggtgtccgcgccgacgaagagcgtggatggtgcgaacagcgccccggaggctcacgcatctgctaccagccgcgctcgctgcctgtcgattcgctgccgatggagagcgctctcggcatgaccgccgccgctgcgccgagccttacgcggcccgtcgatatcgatgtcactgtgatcaaccctcttggccgcagcaccacctacacgttcaaggacggaaagatggtgtcgaccaagggtgatccgtcgccgaactgccctgccagctacaaggagcagagctacgacgccaatgggtaccctgatctggtccatgatttccaggacaatctgaccaacttcgactacagcgcacagggctacctgctgaagcgggtggaagcggtcggcagcacggccgaacgtacgacgttgcaggagtgggataccgcgcgtaaccggctgctcaagacaacggtggtgggtgatcttgaagtcgcctacacctatgacgatcgcggaaacgtggccagcgtgactgagcgcaatctgacggcacgtggggtgcccagccagacgcgggtaacccgcaccacctatagctatcacgccaatggattgaaggcctcgatcaaaatcgatggcccgcttccgcaggatgacgtcacctcgaccttcaacaaccagggcgatctgaccagcaccaccaacgctctcggtcatacgatcagctattccaacttcaacggcttgggattgccgggacgtatcgtcaatgcgaacggtggtgtgcgggagctgacgtatgacggtcgtggccgcgttgtgtccgacagaaccagctcgggaaccggctgggcgaccacagccattggctacacctccgcaggcgacatcgcctcgctcacccagcccgatggcgtgacggtacgctacggctacgatgcaggacgccgcctgacgcatgaagtccgctcgctgggagacggtacgtgggcgtggacccgtcatagctacaacaacgcttccaaccgcacgcgtaccgaggtttcacagaccgactatccgatcgatacggcagtcaagggaatgattgacgaaatcacccatgacgggcagtggaactggttcgctcgaggctgggcctgctccaccggatcggccggatccatccaggtggatggctacgccgaaggcaacgtctacctgggaagcacccaggcaaacctcgccagcgagccaggggttgctgccgcctgccaagcctcaggcaatggctatagataccagctgccgatatcgctggcccagaggcagcagctgggtggccgcaagttctccatctacggtgtatctccgaagggagcacagcacaaccaagcgctgggcaactccggcaacttcgccattcccacggcaacgatcatcggagacgtcgcaggggttacgaacgacgcgaactggaacttctccgtacaaggatgggcatgctccgtgggcgtcaacgcggccaccaccgtacacatctatgcgggagggccggcaggcgctggtacgtatcttgggagcgttaccggcacgctggttccgaacgacgacgtaaaggccgcatgccaatcgcaaggggcgtattggtttggcttcacgttggattccaatatgcgcaacgcacatggcggaaagcccatctacgtccacggcatctcgccctcgggccaggctcatctgctgctcaatcgatcaggagccttcaccatacctgccgtcgtccgaaatgcggaactggtcagcgcatcggcatcaccccgccagatattcaatggtggctcgtcgaatctgacgttccagttccgaaataccggcaacgtcgtgtggaatcctggtgacacctatctggcattcggaattcttcagctcaatgaaagcatgggcctagctggaccggtgcctcctggagcagttgcaaccttcagcagaagcgttggtccgaagaacaccggcaatggcaacgtcaccttcatctacaaggcgcagatggcctctggcggtactgcgtggggcccggaggggagggcgacattgtctgtagagaacaacaagggaagctgtggtcgcgtcacgtgcgaacggcctcggtaa

SEQ ID NO: 190 - DNA, 3018 bp, Stenotrophomonas Sp.
atggacaatggcggtggcggcggtgcaattccgaccgaaacggcgaaggaacagccgaccgatgacaaggagaaggactgtaatggccgcaagggcaatcctgtcgtgctctacagcggcaacaaggtcgagccggaactcgatttcgccagccagggcgaaatgggcctgttcctgcagcgcaactacaatcattactggagcgcgaccggtctgttcggcaatcattggctgagcaacttcgactattcgctcgcgttcaccgatgcaaaccagctggcgtgggtacaacggcccgacggtcgccgcatcaagtatctcaaggatccagccagcggccgctggtacgaggacaaggcccagcccatcgcgtatctcgccgcgaacggagacggcacgttcacgcttcgaaacgaaaacaacgggacggaaatctacaacgccgagggctacatcacccggctcagcaatgagcaaggtgtgagctggacgttctcctataccgatcgctacctgcagaaggtcacccactcctcgggacgcagtatcagctttggctggaccaatggacaggtctcccaggtgaccgacccggccggcaacatctaccgctacacctatacccccaacgtgttcgggaatgggcgtggtcggctcgccagcacgacattgccaggcgctcctgcaacgacgatcagctaccactacgaagacggccgcttcccgggtgccctgaccggcaagtcctttgacggcgtgcgctattccacgtttgcctacgacgcggagcggcgcgccatcagcaccgagcacaatggcggcatcgaacgattccgcttcagctacgccgtgcgcagcaccgaaccggtgcttccgccccccgcccccgctcgaccgggcggtgtccgcgccgacgaagagcgtggatggtgcgagcagcgccccggaggctcacgcatctgctaccagccgcgctcgctgcctgtcgattcgctgccgatggagagcgctctcggcatgaccgccgccgctgcgccgagccttacgcggcccgtcgatatcgatgtcactgtgatcaaccctcttggccgcagcaccacctacacgttcaaggacggaaagattgtgtcgaccaagggtgatccgtcgccgaactgccctgccagctacaaggagcagagctacgacgccaatgggtaccctgatctggtccatgatttccaggacaatctgaccaacttcgactacagcgcacagggctacctgctgaagcgggtggaagcggtcggcagcacggccgaacgtacgacgttgcaggagtgggataccgcgcgtaaccggctgctcaagaccacggtggtgggtgatcttgaagtcgcctacacctatgacgatcgcggaaacgtagccagcgtgactgagcgcaatctgacggcacgtggggtgcccagccagacgcgggtaacccgcaccacctatagctatcacgccaatggattgaaggcctcgatcaagatcgatggcccgcttccgcaggatgacgtcacctcgaccttcaacaaccagggcgatctgaccagcaccaccaacgctctcggtcacacgatcagctattccaacttcaacggcttgggattgccgggacgtatcgtcaatgcgaacggtggtgtgcgggagctgacgtatgacggtcgtggccgcgttgtgtccgacagaaccagctcgggaaccggctgggcgaccacagccattggctacacctccgcaggcgacatcgcctcgctcacccagcccgatggcgtgacggtacgctacggctacgatgcaggacgccgcctgacgcatgaagtccgctcgctgggagacggtacgtgggcgtggacccgtcatagctacaacaacgcttccaatcgcacgcgtaccgaggtttcacagaccgactatccgatcgatacggcagtcaagggaatgattgacgaaatcacccatgacgggcagtggaactggttcgctcgaggctgggcctgctccaccggatcggccggatccatccaggtggatggctacgccgaaggcaacgtctacctgggaagcacccaggcaaacctcgccagcgagccaggggttgctgccgcctgccaagcctcaggcaatggctatagataccagctgccgatatcgctggcccagaggcagcagctgggtggccgcaagttctccatctacggtgtatctccgaagggagcacagcacaaccaagcgctgggcaactccggcaacttcgccattcccacggcaacgatcatcggagacgtcgcaggggttacgaacgacgcgaactggaacttctccgtacaaggatgggcatgctccgtgggcgtcaacgcggccaccaccgtacacatctatgcgggagggccggcaggcgctggtacgtatcttgggagcgttaccggcacgctggttccgaacgacgacgtaaaggccgcatgccaatcgcaaggggcgtattggtttggcttcacgttggattccaatatgcgcaacgcacatggcggaaagcccatctacgtccacggcatctcgccctcgggccaggctcatctgctgctcaatcgctcgggtacgttcacagttcccgcggtagtgcgcaacgccgaagtcgttggcgcgtcggcctatccgtaccagatcttcaatggcggctcctcaacattgatcttcgagttccgcaacacaagcaatgtggtctggaatctaggcgatacctacctcgcgttcggcctcaatcagcccaacgagaacatcgcactctctgcgccggtgccacccggtggcgtggccaggttcagccgcagcgtggggccgaataatccgggcagcgggaatcgaacgttctcgtacgtggcgagaatggcgtccggcggcgttgcctggggcgcggaagcaaaggtcttcctgtctgttgagaacaacaagggaagttgcggtcgcgtcgtctgcgaacgccctcggtaa

SEQ ID NO: 191 - DNA, 3225 bp, Stenotrophomonas Sp.
atgatgcactttgcaacacggaacactctgaagtcccgtcttcttcttctgccgctgctttccctgccgatgacattggcaacggcggcaaacactctcgaaaccgttcaagtcaccgccaaacgccctgctggaggtggcggtgtaggtggttttggatttggcggcggcagtggtgtccacctgtccgagtctcaaatggacaatggcggcggcggcggtgcaattccgaccgaaaccgcgaaggagcagccgaccgatgacaaagagaaggactgcaatggtcgtaagggcaatcccgtcgtgctctacagcggcaacaaggttgaaccagaacttgatttcgccagtcagggcgaaatgggactgttcctgcagcgcaactacaatcactattggagcgcgaccgggctgttcggcaatcactggctgagcaacttcgattattcgctcgcattcaccgatgcaaatcagctggcgtgggtgcaacggcctgacggtcgccgcatcaagtacctcaaggatcctgccagcggtcgctggtatgaggacaaggcccagcccatcgcgtacctctccgcgaacggcgatggcacgtttacgcttcgaaacgaaaacaacggtacggagacctacaacgtcgagggctatatcacccgactcagcaatgagcagggcgtgagctggacgttctcctatgctgaccgctatctgcagaaggtgacccactcctcgggacgcagcgtcagctttggttgggccaatggacaggtaagccaggtgaccgatccagccggcaacgtctatcgctacacctatacccccaatgttttcgggaacggacgtggccggcttgccagctcgacgctgccaggcacaccagcgacgacgatcagctaccactacgaagatgctcgcttcccgggtgccctgactggcaagtcctttgatggcgtgcgctattccacttttgcgtacgacgcggagcggcgcgccatcagcacggagcacaacggtggcattgagcgattccgcttcagctatgccgtgcgcagcaccgaaccggtgctcccgccgcccgcaccgactcgacccggcggtgtccgcgccgacgaagagcgtggatggtgcgaacagcgcaccggaggctcacgcatctgctatcaaccgcgctcgctgcctgttgactcgctgccgatggagagcgctctcggtatgacggccgccgctgcgccgggccttacgcggcccgtcgatattgatgtcactgtgatcaaccctcttggccgtagcaccacttacacgttcaaggacggaaagatggtatcgaccaagggtgatccgtcgccgaactgccctgccagctacaaggagcagagttatgacgccaatggatacccggatctggtccatgacttccaggacaatctgaccaacttcgactacagcgctcagggttacctgctgaagcgggtggaagctgtcggcagctcggccgaacgtacgacgttgcaggagtgggataccacgcggaacagactcctcaagacaacggtggtgggtgacctcgaggttgcctactcctatgacgatcgcggaaacgtggccagcgcaaccgagcgcaatctgacggcacgtggcgtacccagccagacacgagtgacccggagcacgtatacctatcacgcaaacggattgaaggcctcgatcaaagtcgatggaccgcttgcgcaggacgacgtcacctccgtgttcaacggccaaggcgatctgaccagcgtcaccaacgcactcggtcatacgatcagctattccaactacaacggattggggttgccgggacgcatcgtcaatgcgaatggtggtgtgcgagagctgacgtatgacggccgcggccgcgttgtatccgacagaaccagttcgggaaccggctgggcgactaccgccattggctacaccgctgcaggtgacatcgcctcgcttacccagcctgatggcgtgacagtccgctacggctacgatgcagggcgccgcctgacacaggaagtccgttcgatgggagacggcaagtgggcgtggatccgtcatagctacaacaacgcttccaatcgcacgcgcactgaggtttcacaaaccgactatccgatggatacggtcgtaaaggggatgattgatgaaatcacccacgacggccagtggaactggttcgttcgaggttgggcctgctccaccggatcggcgggatccatccaggtggacggttacgccgatggcaacgtctacctgggtagcactcaagcaaaccttgccagcgagccaggagttgccgcggcgtgccaagcatcagggagtgcctataggtatcagttgccgatatcgctagcccagaggcaacagttgggcggtcgtaagttttccatctacggccaatctccgcaggggcgcggccaggaccgaccgcttccgaactctggggtgctcgcgattccaacggcaaaaatcgttggtgacatcggcggcgtgacccaggacgggaactggaacttcttcctggaaggctgggcctgctcgatcggcgtggactcatcgatcgatgtacacgtctatgcaggaagctccgcttgggcagggggcacctttgttgccagtggtcgtgccaacctcgcaacggacggcaacgtcgccagcgcttgccaagcacgcggaaatgcgtattggttcaagattccactcgatggcaatctgcgatcagcgcatggtggcaaggcgctttatgttcatggcatctcgccgtggggtggtgatcatctgaccatcaatcgctcgggcactttcaccgtcccagccgttgtgcggagtgcggagttcgtttccttcaatgcctatcccaccaacatcaccaatggacggcaaagcacgttgaccatacaggtccgcaacacaggcaacgtcgtatgggatggaaacacttaccttgcatggggccaggaccagctggatcaatcccgagcactggccgggccggtgtcccctggagggattgcatcgttcagcatcgacgtcgcgccctaccacgatggcatcgggatcaggagctttgcatacattgcccagatggcgaccaacggtatggcttggggaccccggccctacaccatgatcgcggtagaaaacgcggattggtactgcccgccaaacagcaccacctgcgaggcgccgatgtga

SEQ ID NO: 192 - DNA, 3222 bp, Pseudomonas Sp.
atgatgcacgtcgcaacacggaacactctgcagtcccgtcttcttcttctgccgctcctttccctgccgatgacattggcaactgcggcaaacactctcgaaaccgttcaggtcaccgccaaacgccctgctggaggtagcggtgtaggtggttttggatttggcggcggcagtggtgtccacctgtccgagtctcaaatggacaatggcggcggcggcggtgcaattccgaccgaaaccgcgaaggagcagccgaccgatgacaaagagaaggactgcaacggccgcaagggcaatcctgtcgttctctacagcggcaacaaggtcgaaccagaacttgatttcgccagccagggcgaaatgggcctgttcctgcagcgcaactacaatcactactggagcgcgaccgggctgttcggcaatcactggctgagcaacttcgactattcgctcgcattcaccgatgcaaatcagctggcgtgggtgcaacggcccgacggtcgtcgcatcaagtacctcaaggatccggccagcggtcgctggtatgaggacaaggcccagcccatcgcgtacctctccgcgaacggcgatggcacgtttacgcttcgaaacgaaaacaacggtacggagacctacaacgccgagggctatatcacccgactcagcaatgagcagggcgtgagctggacgttctcctatgctgaccgttacctgcagaaggtgacgcactcctcgggacgcagcgtcagctttggctgggccaacggacaggtcagccaggtgaccgatccagccggcaacatctatcgctacacctatacccccaatgttttcgggaacggacgtggccggcttgccagctcgacgctgccaggcacaccagcgacgacgatcagctaccactacgaagatgcccgcttcccgggtgccctgactggcaagtcttttaatggcgtgcgctattccacgtttgcgtacgacgcggagcgccgcgccatcagcacggagcacaacggtggcattgagcggttccgcttcagctacgccgtacgcagcaccgaaccggtgcttccgccccccgctccgactcgacccggcggtgtccgtgccgatgaagagcgtggatggtgcgaacagcgcaccggaggctcacggatctgctatcaaccgcgctcgctgcctattgactcgctgccgatggagagcgctctcggtatgacggccgccgctgcgccgagccttacgcggcccgtcgatattgatgtcactgtgaccaaccctcttggtcgtagcaccacttacacgttcaaggacggaaagatggtatcgaccaagggtgatccgtcgccgaactgccctgccagctacaaggagcagagttatgacgccaacggatatccggatctggtccatgatttccaggacaatctgaccaacttcgactacagcgcacagggttacctgctgaagcgggtggaagcggtcgggagctcggccgaacgtacgacgttgcaggagtgggataccacgcgcaaccgactcctcaagacaacggtggtgggtgatcttgaagttgcctattcctatgacgatcgcggaaacgtggccagcgcaaccgagcgcaatctgacggcacgtggagtgcccagccagacgcgagtgacccgaagcacgtatacctatcacccaaacggattgaaggcctccatcaaagtcgatggaccgcttgcgcaggacgacgtcacctccgttttcaacagtcagggcgatctgaccagtgtcaccaacgcgcttggtcatacgatcagctattccaactacaacggactggggctgccggggcgcatcgtcaacgcgaacggtggtgtgcgagagttgacgtatgacggccgtggccgcgttgtgtccgacagaaccagttcgggaaccggctgggcgacgaccgcccttggctacaccgctgcaggtgacatcgcctcgcttacccagcctgatggcgtgacagtccgctacggctacgatgcagggcgccgcctgacgcaggaagtccgttcaatgggggacggcaagtgggcgtggacccgtcatagctacaacaacgcttccaatcgcacgcgcactgaggtttcacaaaccgactatccgatggattcgatggtgagcggcgtgattgacgaaatcactcatgatgcgcagtggaactggttcgtgcgtggctgggcctgttccactggctcggctgggtcaatccaggtggacggttacgccgacggcaacgtctacctaggtagcactcaagcaaaccttgccagcgagccaggagttgcagcggcttgccaagcatcagggagtgcctataggtatcagttgccgatatcgctagcccagaggcagcagttgggcggccgcaagttctccgtctacggccaatctccgcagggccgcggccaggatcgaccgctcgcgaactcaggcgtgtttgcgattccaacggcaaacatcgttggtgacatcggcggcgtgacccaggacggcaactggaacttcttcattgaaggctgggcctgctcagttggcgtggacgcctcgatcgacgtacacgtctatgccggtggcgcagctggtggcggtacattcgtcgcttcgggccgcgccaacttggcgaccgacggaaacgttgccaacgcgtgccaggcacgcggaagtgcctattggttcaagattcctcttgacggcaacgtacgatcgaatcacgggggcaaagcactatacgtgcacggtatctcgcctgttggcggtccgaacctgaccatcaatcgctcgggcactttcaccgttccggccgttgtgcggagtgcggagttcgtttccttcaacgcctatcccaccaacatcaccaatggacggcaaagcacgttgaccatacaggtccgcaacacaggcaacgtcgtatgggacggaaacacctaccttgcatggggccaggaccagctggatcaatcccgagcactggctgggccagtatcccctggagggattgcatcgttcagcatcgacgttgcgccctaccacgatggcatcgggatcaggagctttgcatatattgcccagatggcgaccagcggtagggcttggggaccccggccctacaccatgatcgcggtagaaaacgcggattggtactgcccgccaaacagcaccacctgcgaggcgccgatgtga

SEQ ID NO: 193 - DNA, 2223 bp, Streptomyces Sp.
atgggacaccggagcagcgagcttcgccgccgcaggcgccgcaggctcacccgcaggagcgccctggtcgccgccgtggttgcggcagggctggtggcggggacgctcggcatccgcaccgcgctggagtcgacggccgtgaacagcgccgtcacggccgcggagggcgcggccgaccactccgggtcgcaggccgggctggtgagcgacgacgggtcgggggagaccggcaccgccgagggaggaacccaggcgcccgccccgaagcgggacgagaaggccaccccgctcaagtccatacccaaggaccagcccgaacgcggcctggtgtacgcggggttgagcctgccgagcagcgaccgctgcggcggcaccctggaggtcaccggcagtgcccagtgcagccacgggccggacgtgccgccgaagggcgtggacatccaccaggacgtcccgccggtcgcggccccggccggccaggcccccacgctcaccccgcccgcgggtgctcagccgcccgccgcctccgatctgctgaagggtgccgcgcccgtcctggacgccacccagaaggctctgctcggcgggtcgggcagcgccgccgcggacgccgctccggcggctccggccgcgcccgccgcctcgaagctggtctgcgagggcgacggcagcagcggcaaccgcgtccaggcggtgtacgtgcacaccccgggcaacgaccgcttcgcccagtacctggcctcgttcaagaagtgggccgccgacgtcgacgtcatctacaacgccagcgccgcggagaccggcggcgagcggcacgtccgcttcgtcaccgaatccgactgcaccgcctcggtgttgaacgtgcagatctccgacgccgagatccaggacttcaacgcgagcaaccgcgccctcgccgcgcaggggttcaaccgcaaggaccgcaagtacatgatgttcaccgatgccaaggtgtactgcggcatcggcaccttcgccggcgacgagcgtcccggccaggacaacctcagcaacttcggcccctcgtacggccggaccgactccggctgctggagcggcagcaccgccgcgcacgaactcggccacaacctcggcgcggtgaacaacagcgcgcccaactccagcaaggccgggcactgcaccgacgagtgggacatcatgtgctactcggacgcccccaactacccgcagatgcggaccgtctgcccggatcgagcccatgacgaccggctcgactgcaaccacgacgactactacaacacctctcccgcgcccgggagttacctggccacgcactggaacgtcgccaacaaccgcttcctggtctccggcggcggcaccggcccgaccccgacgcccacgccgaccccgacgcccacgccgacccgtactccctcgccctccccgacgcccaccggcggccccaccaccaccccgacgcccacggctacgccttcgccgaccggaaccacgactccgactccgactccgactccgaccccgacgcaggggaacaccggaccggacatgacggtcagtcaggtcacccagaactcggccatgttgagctggccggcagtgccggcggccgccgggtacgacgtcctgctgaacggtcagacgatcggcaccgtccgctcgaccgtggtcggcgtggtccgcctcgctccgggcacctcgtacaccgtggccgtcgccgtccgcgacgccgcgggggcggtcggcaagcccggtcgcgccgtgaccttccgcaccgtcgccgacgccgggcgcccgcagccgggtacgcggtacaccatggtcaacggcctcaccggccaggccgccgacctgtggggcagctcgatgaacgacggcaccgtggccatcgcctaccagcgcaccggctacgccaaccagaagtggcagttcgaggacgccgggaacggcgcggtgcggatcaagtccgtgcgctccggcaagtgcctgcagctcggcggcactccggtcgccggccagtacgtcgcgcagcagccctgctccgatgcggccgcgcagaagtggcaactcaccgccggtgacggcgggttcaccgtcacggcggacggcagttcgctggtgctcgggctcagcgagcggtggtactacggtggttggctgctggagctgcagcagccgaacggccggccgtaccagagctggtcgctgctgaagacctcgtaa

SEQ ID NO: 194 - DNA, 2253 bp, Streptomyces Sp.
atgggacaccggagcagcgagcttcgccggcgcaggcgccgcaggctcacccgcaggagcgccctggtcgccgcggcggtggcggtcggactggtggcggggacgctcggcatccgcagcgcgctggagccgacggccgtgcacggtgccgtcacggccgcggagggcgcggccgaccactcggggtcgcaggccgggctgatcaccgacgacggcgggccgggggagaccggcaccgccgaggggggcgcccaggcgcccgccccgaagcgggacgagaaggccgcgccgctcaagtccatacccaaggaccagcccgaacgcggcctggtctacgcggggttgagcctgccgaccagtgaccgctgcggcggcacgctggaggtcaccggcagcgcccagtgcagccacggtccggacgtgccgcccaagggcgtggacatccgccaggacgtcccgcccgtcgcggccccggccgcccaggcgcccgcgctcacccccgcggccggtgcgcagccgcccgccgccgccgacctgctgaagggtgccgcgcccgtcctggacgccacgcagaaggccctgctcggcggctccggcagcgccgccgcggacaccgctccggtcgccccgagtgcttcggccgcgcccgccgggtcgaagctggtctgcgagggtgacggcagcagcggcaaccgggtccaggcggtgtacgtgcacaccccgggcaacgaccggttcgcccagtacctggcctcgttcaagaagtgggcagccgacgtcgatgtcatctacaacgccagcgccgcggagaccggaggcgagcggcacgtccgcttcgtcaccgaatccgactgcaccgcctcggtgttgaacgtgcagatctcggacgccgagatccaggacttcaacgcgagcaaccgcgcgctcgccgcgcaggggttcaaccgcaaggaccgcaagtacatgatgttcaccgatgccaaggtgtactgcgggatcggcaccttcgccggcgacgagcgccccggccaggacaacctcagcaacttcggtccctcgtacggccggaccgactcgggctgctggagcggcagcaccgccgcgcacgaactcggccacaacctgggcgcggtgaacaacagcgcgcccaactccagcaaggccggccactgcacggacgagtgggacatcatgtgctactcggacgccccgaactacccgcagatgcggaccgtctgcccggatcgcgcccaggacgaccggctcgactgcaaccacgacgactactacaacacggctccgaagcccggtagttacctgaccacgcactggaacgtcgccaacaaccgcttcctgatcgccggcggtggaaacggcggcggcaccggtccgagcccgacacccaccccgaccccgacggccacgcccacccgtacgccctcgccgtccccgacgcccaccggcggtcccaccgccaccccgaccggctccccgacgccgaccccgaccgccacgccgaccccgaccgccacgccgaccccgaccgcgacgccgaccccgggcaacaccggcccggacatgacggtcagccaggtcacccagacctccgccatgctgagctggaacgcggcgcccgcggccgccgggtacgacgtcctgctgaacggccagccgatcggcaccgtccgctcgaccgtggtcggcctggtccgcctcgctcccggcacctcgtacaccgtggccgtcgccgtccgggacgccgccggggcggtcggcaagcccggccgctccgtgaccttccgtaccgtcgccgacgccggacgtccgcagccgggcgcggcctacaccctggtcaacggcctcaccggccaggccgccgacctgtggggcagctcgatgaacgacggcaccgtcgccatcgcctaccagcgcaccggctacgccaaccagaagtggcagttcgaggacgccggaagcggtgcggtgcggatcaagtccgcccgctccggcaagtgcctccagctcggcggcgcgccggtcgccggccagtacgtcgcccagcagccgtgctccgacgcggccgcgcagaagtggcaactcacctcgaccgacggcggcttcaccgtcacggcgggcggcggcgggctggtgctcggtctcagcgaccggtggtactacggtggttggctgctggagctgcagcagccgaacggccggccgtaccagagctggtcgctgctgaagacctcgtaa

SEQ ID NO: 195 - DNA, 954 bp, Streptomyces Sp.
gtgagcaccgccgagaccgaccgcgccgccacccccgccgccgacccgcgggtggaggtcctgcccgcccgggacgtgccgctcggcggcccgcgcgcgatgaccgtacgccgcaccctgccccagcgctcccgcagcacgatcggcgcctggtgcttcgtcgaccactacgggcccgacgacgtcaccagcaccggcggcatggacgtcgccccgcacccgcacaccggactgcagaccgtgagctggctcttcaccggcgagatcgagcaccgcgacagcctcggcgtccacgcgtacgtccggcccggcgaggtcaacctgatgacctccggccgcggcatcgcccactccgaggtctccaccccggccaccaccgtcctccacggcgtccagctgtgggtcgccctgcccgaggagcaccggcacaccgggcgcgacttccaccaccacgtgcccgcccccgtcgccctggacggcggcgaggcccgggtcttcctcggcaccctcgccggcgacacctcccccgtccccaccttcaccccgctgctcggcgccgagctgaccctgcaccccggggccaccgtcaccctcgacgtcgaccccgccttcgaacacggcctgctggtcgacagcggacacgtccgtctcctcgacaccccgctgcgccccgccgaactcggctacgccgcccccggccgcgacaccctcaccctcaccaacaccggcgacaccgacgcccgcctggtcctgctcggcggcacgcccttcgaggagcagatcgtcatgtggtggaacttcatcggccgatcccacgaggacatcgtccaggcccgcgacgagtggcaggccgccaccgaccgcttcggcgccgtccagggctaccccggcgaccgcctccccgcccccgaactccccggcctccccctcaagccccgcggaaacgcccgctga

SEQ ID NO: 196 - DNA, 954 bp, Streptomyces Sp.
gtgagcaccgccgagaccagcctcgtcgagccgaacgccgccgatccgcacgtggaggtcctgcccgcccgggacgtcccgctcggcgggccgcgcgcgatgacggtacgccggaccctgccgcagcgctcccgcaccctcatcggcgcatggtgcttcgtcgaccactacgggcccgacgacgtcgccggtaccggcggcatggacgtcgccccgcacccgcacaccgggctccagacggtcagctggctgttcaccggcgaaatcgagcaccgggacagcctcggcgtccacgcgtacgtgcgaccgggcgaagtgaacctgatgacctccggccacggcatcgcccactccgaggtctccaccccggccaccacggtcctgcacggcgtccagctgtgggtcgccctgcccgaggaacaccggcacaccgcccgcgacttccaccaccacgcaccggccccggtcgccctcgacggcggcgaggcccgcgtcttcctcggctccctcgccggcgacaccgcccccgtccccaccttcaccccgctgctcggcgccgaactcgtcctgcgcccgcacgccaccgtcaccctcgacgtcgaccccgccttcgaacacggcctcctggtcgaccacggcgagatccgcttcgccgacaccccgctccacgccgccgaactcggctacctcgcccccggccccgccacgatcaccctcaccaacaccaccgacagcgacgcacgagccgtcctactgggcggcacgcccttcgaggaacagatcgtcatgtggtggaacttcatcgggcgcacccacgaggacatcgcccaggcccgcgccgaatggcaggccgccgccgaccgcttcggcgccgtcgagggctaccccggcgaccgcctgcccgccccggagctccccggcacccccctcaagccgcgcggccgcgtgcgctga

SEQ ID NO: 197 - DNA, 963 bp, Streptomyces Sp.
gtgagcaccgccgagaccgacctcaccgagccgatcgccgccgacccacgggtggaggtcctgcccgcccgggacgtcccgctcggcggcccccgcgcgatgaccgtccgccggacgctgccacaacgctcccgcagcctgatcggcgcctggtgcttcgtggaccactacgggcccgacgacgtcgccggcaccggcggcatggacgtcgccccgcacccgcacaccgggctgcagacggtcagctggctgttcaccggtgagatcgaacaccgggacagcctcggcgtgcacgcgtacgtccggccgggcgaggtgaacctgatgacctccggccacggcatcgcccactccgaggtctccaccccgaacaccacggtcctgcacggcgtacagctctgggtcgctctgcccgaggagcaccggcacaccggccgcgacttccaccaccacgcgcccgccccggtcgcgctggacggcggcggcgaggcccgggtcttcctcggcaccctcgccggcgacacctcccccgtccccaccttcaccccgctgctcggcgccgaactcgtcctgcgcccgcacgccaccgtcaccctcgacgtcgaccccggcttcgagcacggcctcctcgtcgaccacggcgacatccgcttcgccgacaccccgctgcggcgcgccgaactcggctacctcgcccccggccccaccacgatcaccctcaccaacaccaccgacagcgacgcccgcgccgtcctgctgggcggcgcgcccttcgaggagcagatcgtcatgtggtggaacttcatcgggcggtcccacgaggacatcacccgagcccgcgaggagtggatgagctccgtgaactccgaccgcttcggcgaggtccacggctacccgggcgaccgcctccccgcccccgagctccccggcacccccctgaagccccgcggacgtctgcgctga

SEQ ID NO: 198 - DNA, 966 bp, Streptomyces Sp.
gtgagcaccgccgagaccgacctcaccgagccgaacgccgccgctgccccacgggtggaggtcctgcccgcccgggacgtcccgctcggcggcccccgcgcgatgaccgtccgacggacgcttccgcaacgctcccgcaccctcatcggcgcctggtgcttcgtggaccactacgggcccgacgacgtcgcgggcaccggcggcatggacgtcgccccgcacccgcacaccgggctgcagaccgtcagctggctgttcaccggcgagatcgagcaccgggacagccacggcgtgcacgcgtacgtccgcccgggcgaggtgaacctgatgacctccggccacggcatcgcccactccgaggtctccaccccggacaccaccgtcctgcacggcgtccagctctggatcgccctgcccgcggaacacctgcacaccgcccgcgacttccaccaccacgcgcccgccccggtcgccctggacggcggcggcgaggcccgggtcttcctcggcaccctcgccggggacacctcccccgttcccaccttcaccccgctgctcggcgccgagatccacctgcgcccgcacgccaccgtcaccctcgacgtcgaccccgccttcgaacacggcctcctcgtcgaccacggcgacatccgcctcgccggcaccccgctgcggcgcgccgaactcggctacctcgctcccggccccaccaccatcaccctcaccaacaccaccgacggcgacgcccgcgccgtgctgctgggcggcacgcccttcgaggagccgatcatcatgtggtggaacttcgtcgggcggtctcacgaagacattacccgagcccgcgaggaatggatgagctccgcgaaccccgaccgcttcggcgccgtcgagggctacccgggcgaccgcctgccggctccggagcttccgtcgattccgctgaaggcacgcggccgggcgcgctga

SEQ ID NO: 199 - DNA, 852 bp, Kitasatospora Sp.
gtgagcaccgccgagaccgaccgcgccgccacccccgccgccgacccgcgggtggaggtcctgcccgcccgggacgtgccgctcggcggcccgcgcgcgatgaccgtacgccgcaccctgccccagcgctcccgcagcacgatcggcgcctggtgcttcgtcgaccactacggtcccgacgacgtcaccagcaccggcggcatggacgtcgccccgcacccgcacaccggactgcagaccgtgagctggctcttcaccggcgagatcgagcaccgcgacagcctcggcgtccacgcgtacgtccggcccggcgaggtcaacctgatgacctccggccgcggcatcgcccactccgaggtctccaccccggccaccaccgtcctccacggcgtccagctgtgggtcgccctgcccgaggagcaccggcacaccgggcgcgacttccaccaccacgtgcccgcccccgtcgccctggacggcggcgaggcccgggtcttcctcggcactctcgccggcgacacctcccccgtccccaccttcacccccctgctcggcgccgagctgaccctgcaccccgcagccaccgtcaccctcgacgtcgaccccgccttcgaacacggcctgctggtcgacagcggacacatccgcctcctcgacaccccgctgcgccccgccgaactcggctacgccgcccccggccgcgacaccctcaccctcaccaacaccggcgacaccgacgcccgcctggtcctgctcggcggcacgcccttcgaggagcagatcgtcatgtggtggaacttcatcgggcggtcccacgaggacatcgtccaggcccgcgacgagtggcaggcc

SEQ ID NO: 200 - DNA, 348 bp, Streptomyces Sp.
atgtcgcagcaagcgccggacaacaccgagggacagacgctgccgttctgggtcgacgtcgtggaggaggagggcgaggacggcaacgcgatgggcggcctcttccggcacgacggcgaggccgtcctgcgctccgtccccctcggccccctgcgcaagaatctggccgatacggtcgacgccctccagaaggtcttcgaggaggtcgccgaccggggcggcgcgctcccgctcgccgaggcccagctctccttccaggtcaccgccaccggcggcatccagctcatcggcagtggccaggtgcagggcacccgcggtctgactctgacgttcaagcgcccgtcgtag

SEQ ID NO: 201 - DNA, 621 bp, Streptococcus Sp.
atgaagggtttggtcaaagctgcagttttaactgttactcttgggattggaggcgctttctattcaagtgatgcatctgcgcacgggtatataaaagagcccgtcagcagagcgtacatgggagctttagagaaacaaacattgggctggacggccgctgcgcagaaatatggctccgtcattgataatcctcagtctgtagaagggacgaaaggatttccggctgcaggtccgccggatggaagaattgcgtctgcaaatgggggatcgggacaaattgacttcggtttagacaagcagactgcagattattgggtaaaacaaaacatccgcggcggttttaacacctttacttggtactacacggctcctcatgcgacatcaaagtggcactattatatcaccaagaaaaactggaatccgaataaacctttgtcaagagatgaattcgaattaatcggaacggtaaaccacgacggttccaaggcagatacgaatctgactcataagatttttgtgccgactgatcgaagcgggtatcatgtcattttgggggtatgggacgttgcggatacttccaatgccttctataacgtcatcgatgtaaaccttacacaataa

SEQ ID NO: 202 - DNA, 621 bp, Bacillus Sp.
atgaagggtttagtcaaagctgcagttttaactgttactcttggtattggaggcgctttctattcaagtgatgcgtctgcacacgggtatataaaagagcccgtcagcagagcgtacatgggggcattagagaagcaaacaatgggctggacggctgctgcgcagaaatatggctccgtcattgataatcctcagtctgtggaagggccgaaaggatttccggctgcaggtccgccggatggtagaattgcgtctgcaaacggaggatctggacaaattgatttcggtttggacaagcagactgcagatcattgggtaaaacaaaacatccgcggcggctttaacacctttacttggcactacaccgcacctcatgcgacatcaaagtggcactattatatcaccaagaaaaactggaatccgaataaacctttgtcaagagatgaattcgaattaatcgggacggtaaaccacgacggctccaaggcagatacgaatctgactcataagatttttgtgccgactgatcgaagcggttaccatatcattttaggggtgtgggatgttgcggatacttctaatgccttctataacgtcatcgatgtaaacctcacaaaataa

SEQ ID NO: 203 - DNA, 621 bp, Bacillus Sp.
gtgaagggtttagtcaaagctgcagttttaactgttactctcggtattggaggcgctttctattcaagtgatgcatctgcacacgggtatataaaagatcccgccagcagagcgtacatgggagcattagagaaacagacaatgggctggacggccgctgctcagaaatatggctccgtcattgataatcctcagtctgttgaagggccgaaaggatttccggctgcaggtccgccggatggaagaattgcatctgcaaacggaggatcgggacaaattgatttcggtctggacaagcagactgcagatcattgggtaaaacagaatatacgcggcggctttaattcttttacttggaactataccgcaccccatgcgacatcaaagtggcactattatatcaccaagaaaaattggaatcctaataaacctttgtcgagggatgaattcgaattaatcggaacggtaaaccacgatggctccaaggcagatacgaatctgactcatagaatttttgtgccgactgatcgaagcggttatcatatcattttaggggtatgggatgtagcggatacttctaatgccttctataacgtcattgacgtaaaccttacacagtaa

SEQ ID NO: 204 - DNA, 621 bp, Bacillus Sp.
gtgaagagtttagtcaaagctgcagttttaactgttactctcggtgttggaggcgctttctattcaagtgatgcatctgcacatgggtatataaaagatcccgtcagcagagcgtacatgggagcattagagaaacaaacaatgggctggacggctgctgctcagaaatatggctccgtcattgataatcctcagtctgttgaagggccgaaaggatttccggctgcaggtccgccggatggaagaattgcatctgcaaacggaggatcgggacaaattgatttcggtatggacaagcagactgcagatcattgggtaaaacagaatatacgcggcggctttaattcttttacttggcactataccgcaccccatgcgacatcaaagtggcactattatatcaccaagaaaaattggaatccgaataaacctttgtcgagggatgaattcgaattaatcggaacggtaaaccacgatggctccaaggcagatacgaatctgactcataggatttttgtgccgactgatcgaagcggttatcatatcattttaggggtatgggatgtcgcggatacttctaatgccttctataacgtcattgacgtaaaccttacacagtaa

SEQ ID NO: 205 - DNA, 621 bp, Bacillus Sp.
atgaaaaaatttatcaaaggcgctattctaacggctgctctgggtgttggtgctactttttttgcaagtgatgcctctgcacacgggtacataaaagaacccgctagcagagcatacatgggatcattagaaaaacaaatcattggctggtcggcagctgcacaaaaatatggttccgtaattgataatcctcaatcggtagaaggtccaaaagggtttccggccgctggtccgccagatggcaaaattgcatcggcaaatggaggttccggtcaaattgattttggattagacaggcagaccgcagattattgggcaaaacaagacttgcgcgggggtctgaatacctttacttggcactatactgctcctcacgcaacatcaaagtggcactattatataaccaagaaaaattggaatcccaataaacctttaacaagagatgagtttgaattaattggaactgtcaatcacgatggttcgaaggctgatactaatctttcccataagattttcgtaccgactgatcgcagcggttatcatgtcattctaggcgtgtgggacgttgcggacacctcgaatgccttttataacgtaattgatgtaaacttaaaacaatga

SEQ ID NO: 206 - DNA, 621 bp, Bacillus Sp.
atgaagggttttatcaagggggctgttctaactgctattctaggtgttggtgctactttatttgcaggtgatgtatctgcacacgggtatataaaagaacctgctagtagagcgtacatgggttcattagaaaaacaaataattggttggacggcagctaatcaaaagtatggttccgtaattgataatcctcaatcggtagagggaccaaaagggtttccgtccgcgggtccgccagatgggaaaattgcatcagcaaatggaggctcgggtcaaattgactttgggttagacaggcagactgcagatcattgggtaaaacaaaacatccgtgggggtctaaacacctttacttggcactatactgctcctcatgcaacatcaaagtggcactattatataaccaagaaagattggaatccaaacaaacctttaacaagagatgagtttgaattaattggaactgtagatcatgatggctcaaaggctgatactaatctatctcataagatttatgtaccaactgatcgcagtggttatcatgtcatactaggggtgtgggatgttgcggatacctctaatgccttttataacgtaattgatgtaaacctaatgcgatga

SEQ ID NO: 207 - DNA, 621 bp, Bacillus Sp.
atgaagggttttatcaaaggcgctgttctaactgctattctaggtgttggtgctactttatttgcaggtgatgtatctgcacacggatatataaaagaacctgctagtagagcgtacatgggttcattagaaaaacaaataattggttggacggcagctaatcaaaagtatggttccgtaattgataatcctcaatcggtagaaggaccaaaagggtttccgtctgcgggtccaccagatgggaaaattgcatcagcaaatggaggttcgggtcaaattgactttgggttagacaggcagactgcagatcattgggtaaaacaaaacatccgtgggggtttaaacacctttacttggcactatactgctcctcacgcaacatcaaagtggcactattatataaccaagaaagattggaatccaaacaaacctttaacaagagatgaatttgaattaattggaactgtagatcacgacggctcaaaggctgatactcatctatctcataacatttatgtaccaactgatcgcagtggttatcatgtcattctaggggtgtgggatgttgcggatacctctaatgccttttataacgtaattgatgtaaacctaatacgatga

SEQ ID NO: 208 - DNA, 621 bp, Bacillus Sp.
atgaagggttttatcaaaggcgctgttctaactgctgttctaagtgtgggtgctactttatttgcaggtgatgtatctgcacacgggtatataaaagaacctgctagtagagcgtacatgggatcattagaaaaacaaataattggttggacagcagctacacaaaagtatggttctgtagttgataatcctcaatcggtagaaggacctaaagggtttccagccggaggtccgccagatggaaaaattgcatcggcaaatggaggctttggtcaaattgactttgggttagacaggcagactgcagatcattgggtaaaacaaaacatgcatggaggtctaaacacctttacttggcactatactgctcctcacgcaacatcaaagtggcactattatataaccaagaaagattggaatccaaacaaaccattaacaagagatgagtttgaattaattggaacagtagatcacgatggttcaaaggcagatactaatctttctcataagatttatgtaccaactgatcgcagtggttatcatgtcattttaggggtgtgggacgttgcggatacctctaatgccttttataacgtaattgatgtaaacctaatacaatga

SEQ ID NO: 209 - DNA, 621 bp, Salinibacillus Sp.
atgaagggttttgtcaaaggcgctgttctaactgctgttctgagtgtgggtgctactttatttgcaggtgatgtatctgcacacgggtatataaaagaacctgctagtagagcgtacatgggatcattagaaaaacaaataattggttggacggcagctacacaaaagtatggttctgtagttgataatcctcaatcggtagaaggactaaaagggtttccagccggaggtccgccagatggaaaaattgcatcggcaaatggaggctttggtcaaattgactttgggttagacaggcagactgcagatcattgggtaaaacaaaacatgcatggaggtctaaacacctttacttggcactatactgctcctcacgcaacatcaaagtggcactattatataaccaagaaagattggaatccaaacaaaccattaacaagagatgagtttgaattaattggaacagttgatcacgatggttcaagggcagatacaaatctttctcataaaatttatgtgccagcagatcgcagtggttatcatgtcattctaggggtgtgggacgttgcggatacctctaatgccttttataacgtaattgatgtaaacctaatacaatga

SEQ ID NO: 210 - DNA, 2871 bp, unknown
  environmental sample
atgaagtattcgaagttgagcctggccctggccgggctgatgggcgttgccgccatatccgtggtggatgacgtcatggcaatgaattatcacgtgcagggcgatcgcatcttcctgagtggcgatgtgacctacgccgacgtggtgtccctgccggcactgctggccaaggcgcaggccgaaggccggccggtccgtgaggtggtgctgcgcacgtccaatggtggtgcgttgatcgccggcgagtggctgcagggcatcatccgcacctccggactgaacaccatcgtgtccggcaattgcatctcgtcctgctcgatcatgcagtctggcggcgtcgaacgctatctggccggcgatctgccgctcatcgactcggtgcagatccacgcggccagcagcggcggcaaggtgatctacacgccgtcgccgcgcatgacccagatctacaccggcaactacggtggtggcatggatgccgggctgctgcacaaggccatgtacgaagtggtgaagccgaacggcctgctggtgttccgcgatccggcacgcagcaccggttcctcggtcactttcgaccccgatggcagtggcagcaagctggagtcgttccccggccaggacatctacagcaacaggatcatcaccgcgaacgggtaccgcgatccgggcgacaccttgaatgtcaccgccaacgtgaccggcgacatcaaccccggctacctgcgtaccggacgccagttgcaggcgttcgtcgatgatgatttcgcgcgctggaataccgactggcgatccacctacatcaatctcgcgcagagcatctacaacgcatccagcaagggtccgcagggcatcggtgcgctgtcggtgcagggttacctcagtgacccggacatccaggacctgttgctgtccaagctgcggctggctgatctggatgtctccacgctggacaacgccatgggcgtgatccgggtgaccaacggcgccacctggcgcacgtccacgacgacgggtgcggatttcatgctggtcgacaatggcaccatcgcgctggaaggcggcgccctgcgcgcatcggaagtgcgcgtgctcggcgcaggcatgctggtcggccatggcgacgtggcgggtacggcgatggaccgcgctgcattgctggacggcaccggcccgtcgtaccgcgaagacggtttcaaccgcctgcgcgtgttcggcacgctgatgccgcgcggtggcgacctggtcacccatggctacgtcaacatcatgccgggcggcaaggtgctgttcgacgttacagagaatggtggcaccaccgccggccgcctgcgcgtgggcaccttcttcgatgacgagcagaccgagggggcactggtgatctccaagggggccttcctcgaactgaacgtggcgcagggctactacggccaggacttccgtcgtgacctggttgagggcccgatctaccagggcggcttcgaagaggccgtgcgcctgggcgacaccagctacagcgccagcatcagcggtgatgtgttccgtccccgccacaattcgctgttgagcttcaacgtgaagcagacggccgatggcctgtggctgaccgccaacccgggctttgaccagctgggcctgttcgccaacggtacgtccggcgacggcctgggccgtgcgctggcgactgcttccgatcgccaggacaagggactgaaatcgctgctgggcgcactgcagttcgccgaccgcgatgtgatcgcacaacaggccggtgccctgcgcggtgatgcgcacgccagcctgcgcctggccgacaccgcgctggtgggcagcatcggcaacgtcgtgcagcagcaccagtcggccatgcgcagcggcggcgatgccgatggcctggcctcgcaggtggcgcagtcggtctcctcccagccgggcatgcgccatggcagcctgttcaaccagctggcgatgcacctggtcgagccggcgccgggcagcgttgcgggtagcggtgatgccggacgcagccatggcatctgggcacgtggtttcgccagccatggccgcatcgatgccgacggtggcgtggccggcctgagccacaacatcggcggcatcgtggtcggtgccgacacccgcgtggccgatgaccgcgtgaccctgggcgtaagcgtggccgcggcggacatgtcgaccaaggccagcgatggctctggtttcaccggtgatgtgcgcgcgctggacgtgggcggttacctcgatgcgacgtacgcgcgcggctatctgtcggcggccgtgcgctacaccgatctgcggcatgacacccgtcgcagcatcggcggtatcgatggcctgcagcagcccctgcgcgcgaagtacagcaacgatgcgatctccgcgcgtgttgaacatgcgttctcgttcaccaccggcaagggcctggtgatccagccgttgctgccggtggtggactacgcgcgtacttcggccacccgcttcaacgaagggcagggcgctggtgcgctggttggccgcagtggcagcctggagagcatccgcgtgggtgcgggcctgcagctgttcaagacctttgagggcaacaacggtgagcgcatcacgccgcgcgcccgggtggtctggcagaaggagctgggcgattcgcaggcccgctacagcaccggcttcgccgcggcaccggatctggtgttcggcgccagcagccaggcggtgggcgagcaggtgctggcctggaacgtcggcgtgaccagtcgcgccagcgagcgcctgtcgatcatggccgactacgtgggtgagcgccgcgacgggcagatccagaacggcgtgatgctgggcctgggctaccggttctaa

SEQ ID NO: 211 - DNA, 2871 bp, Stenotrophomonas Sp.
atgaagtattcgaagttgagcctggccctggccgggctgatgggcgttgccgccatatccgtggtggatgacgtcatggcaatgaattatcacgtgcagggcgatcgcatcttcctgagtggcgatgtgacctacgccgacgtggtgtccctgccggcactgctggccaaggcgcaggccgaaggccggccggtccgtgaggtggtgctgcgcacgtccaatggtggtgcgttgatcgccggcgagtggctgcagggcatcatccgcacctccggactgaacaccatcgtgtccggcaattgcatctcgtcctgctcgatcatgcagtctggcggcgtcgaacgctatctggccggcgatctgccgctcatcgactcggtgcagatccacgcggccagcagcggcggcaaggtgatctacacgccgtcgccgcgcatgacccagatctacaccggcaactacggtggtggcatggatgccgggctgctgcacaaggccatgtacgaagtggtgaagccgaacggcctgctggtgttccgcgatccggcacgcagcaccggttcctcggtcactttcgaccccgatggcagtggcagcaagctggagtcgttccccggccaggacatctacagcaacaggatcatcaccgcgaacgggtaccgcgatccgggcgacaccttgaatgtcaccgccaacgtgaccggcgacatcaaccccggctacctgcgtaccggacgccagttgcaggcgttcgtcgatgatgatttcgcgcgctggaataccgactggcgatccacctacatcaatctcgcgcagagcatctacaacgcatccagcaagggtccgcagggcatcggtgcgctgtcggtgcagggttacctcagtgacccggacatccaggacctgttgctgtccaagctgcggctggctgatctggatgtctccacgctggacaacgccatgggcgtgatccgggtgagcaacggcgccacctggcgtacgtccgcgacgacgggtgcggatttcatgctggtcgacaatggcaccatcgcgctggaaggcggcgccctgcgcgcatcggaagtgcgcgtgctcggcgcaggcatgctggtcggccatggcgacgtggcgggtactgcgatggaccgcgctgcattgctggacggcaccggcccgtcgtaccgcgaagacgggttcaaccgcctgcgcgtgttcggcacgctgatgccgcgcggtggcgacctggtcacccatggctacgtcaacatcatgccgggcggcaaggtgctgttcgacgttacagagaatggtggcaccaccgccggccgcctgcgcgtgggcaccttcttcgatgacgagcagaccgagggggcactggtgatctccaagggggccttcctcgaactgaacgtggcgcagggctactacggccaggacttccgtcgtgacctggttgagggcccgatctaccagggcggcttcgaagaggccgtgcgcctgggcgacaccagctacagcgccagcatcagcggtgatgtgttccgtccccgccacaattcgctgttgagcttcaacgtgaagcagacggccgatggcctgtggctgaccgccaacccgggctttgaccagctgggcctgttcgccaacggtacgtccggcgacggcctgggccgtgcgctggcgactgcttccgatcgccaggacaagggactgaaatcgctgctgggcgcactgcagttcgccgaccgcgatgtgatcgcacaacaggccggtgccctgcgcggtgatgcgcacgccagcctgcgcctggccgacaccgcgctggtgggcagcatcggcaacgtcgtgcagcagcaccagtcggccatgcgcagcggcggcgatgccgatggcctggcctcgcaggtggcgcagtcggtctcctcccagccgggcatgcgccatggcagcctgttcaaccatctggcgatgcacctggtcgagccggcgccgggcagcgttgcgggtagcggtgatgccggacgcagccatggcatctgggcacgtggtttcgccagccatggccgcatcgatgccgacggtggcgtggccggcctgagccacaacatcggcggcatcgtggtcggtgccgacacccgcgtggccgatgaccgcgtgaccctgggcgtaagcgtggccgcggcggacatgtcgaccaaggccagcgatggctctggtttcaccggtgatgtgcgcgcgctggacgtgggcggttacctcgatgcgacgtacgcgcgcggctatctgtcggcggccgtgcgctacaccgatctgcggcatgacacccgtcgcagcatcggcggtatcgatggcctgcagcagcccctgcgcgcgaagtacagcaacgatgcgatctccgcgcgtgttgaacatgcgttctcgttcaccaccggcaagggcctggtgatccagccgttgctgccggtggtggactacgcgcgtacttcggccacccgcttcaacgaagggcagggcgctggtgcgctggttggccgcagtggcagcctggagagcatccgcgtgggtgcgggcctgcagctgttcaagacctttgagggcaacaacggtgagcgcatcacgccgcgcgcccgggtggtctggcagaaggagctgggcgattcgcaggcccgctacagcaccggcttcgccgcggcaccggatctggtgttcggcgccagcagccaggcggtgggcgagcaggtgctggcctggaacgtcggggtgaccagtcgcgccagcgagcgcctgtcgatcatggccgactacgtgggtgagcgccgcgacgggcagatccagaacggcgtgatgctgggcctgggctaccggttctaa

SEQ ID NO: 212 - DNA, 2871 bp, Stenotrophomonas Sp.
atgaagtattcgaagttgagcctggccctggccgggctgatgggcgttggcgccatatccgtggtggatgacgtcatggcaatgaattatcacgtgcagggcgatcgcatcttcctgagtggcgatgtgacctacgccgacgtggtatccctgccggcactgctggccaaggcgcaggccgaaggccggccggtccgtgaggtggtgctgcgtacgtccaatggtggtgcgttgatcgccggcgagtggctgcagggcatcatccgcacctccggactgaacaccatcgtgtccggcaattgcatttcatcctgctcgatcatgcagtctggtggcgtcgaacgctatctggccggcgatctgccgctcatcgactcggtgcagatccacgcggccagcagcggcggcaaggtgatctacacaccgtcgccgcgcatgacccagatctataccggcaactacggcggcggcatggatgccgggctgctgcacaaggccatgtatgaagtggtgcaaccgaacgggttgctggtgttccgcgatccggcgcgcagcactggtgcctcggtcaccttcgatcccgatggcagtggcagcaagctggagtcgttccccggccaggatatctacagcaacaagatcatcaccgcgaacggataccgcgatccgggtgacaccttgaacgtcaccgccaacgtggtcggcgacatcaaccctggttacctgcgtaccggacgccagttgcaggcgttcgtcgatgatgatttcgcgcgctggaataccgactggcgatccacctacatcaatgtcgcacagagcatctacaacgcatcaagccgcggtccgcagggcatcggcgcgctgtcggtgcagggctacctcagtgatccggacatccaggacctgctgctgtccaagctgcggctggctgatctggatgtctccacgctggacaacgccatgggcgtgatccgggtgagcaacggcgccacatggcgcacgtccgcgacgacaggcgcggacttcatgctggtcgacaatggcaccatcgcgctggaaggcggtgcgctgcgcgcatcggaagtgcgggtgctcggcgcaggcatgctggttggccatggcgacgtggcgggtactgcgatggaccgcgctgctttgctggacggcaccggtccttcctaccgcgaagacggcttcaaccgcctgcgcgtgttcggcacgctgatgccgcgcggcggcgacctggtcacccatggctacgtcaacatcatgccgggcggcaaggtgctgttcgacgttactgagaatggcggcacggccgccggccgcctgcgcgtgggcacgttcttcgatgacgagcagacagagggggcactggtgatctccaagggtgccttcctcgaactgaacgtggcgcagggctactacggccaagacttccgtcgtgacctggtggagggcccgatctatcagggcggcttcgaagaggccgtgcgcctgggcgacaccggttacagcgccagcatcagtggtgaagtgttccgcccgcgccacaattcactgctcagcttcaacgtgaagcagacggccgatggcctgtggctgaccgccaacccgggctttgaccagctgggcctgtttgccaacggtacgtccggcgacggcctgggccgcgcgctggcgaccgcctccgatcgccaggacaaggggctgagatcgctgctgggcgcactgcagttcgccgaccgcgatgtgatcgcacaacaggccggtgccctgcgcggtgatgcgcacgccagcctgcgactggccgacaccgcgctggtgggcagtatcggcaacgtcgtgcagcagcaccagtcggccatgcgcagcggcggtgatgccgatggcctggcctcgcaggtggcgcagtcggtctcctcccagccgggcatgcgccatggcagcctgttcaaccagctggcgatgcacctggtcgagccggcgtcgggcagcgttgcgggcagcgctgatgctggacgcagccatggcatctgggcgcgtggtttcgccagccatggccgcctcgatgccgacggtggcgtgaccggcctgagccacaccatcggtggcatcgtggtcggtgccgatacccgcgtggccgatgaccgcgtgaccctgggtgtcagcgtggccgcggcggacatgtcgaccaaggccagcgatggctctggtttcactggtgacgtgcgtgcgctggacgtgggcggctacctcgatgcgacgtacgcgcgcggctatctgtcggcggccgtgcgctacaccgatctgcgccacgatacgcgtcgcagcatcaacggcatcgatggcctgcagcagccgctgcgcgccaagtacagcaacgatgcgatctccgcacgggtggaacatgcgttctccttcacgaccggcaagggcctggtgatccagccgttgctgccggtggtggactacgcgcgtacctcggccacccgcttcaacgaagggcagggcgccggtgcgctggttggccgcagcggcagcctggagagcatccgcgtgggtgcgggcctgcagctgttcaagaccttcgaaggcaacaacggcgagcgcatcaccccgcgcgcccgggtggtctggcagaaggaactgggcgattcgcaggcccgctacagcaccggcttcgccgcggcaccggatctggtgttcggcgccagcagccaggcggtgggcgagcaggtgctggcctggaacctgggtgtgaccagccgtgccagcgagcggctgtccatcatggccgattacgtgggtgagcgccgcgacgggcagatccagaacggcgtgatgctgggcctgggctacaagttctaa

SEQ ID NO: 213 - DNA, 2874 bp, Stenotrophomonas Sp.
atgaagcattcgaagttgagcctggccctggccgggctgatcggcgtcggcgccctcgcggcagctgatgacgtcatggcaatgagttatcacgtgcagggcgaccgcatcttcctcagtggcggggtgacctacgccgacgtggtgtcgttgccggcgttgctggccaaggcgcaggccgagggccggccgatccgcgaagtggtgctgcgcacctccaacggcggcgcgctgattgccggcgagtggctgcagggcgtgatccgcaccgccggcctgaacaccatcgtgtccggccactgcatctcgtcatgctcgatcatgcagtccggtggcgttgagcgctatctggccggcgacctgccgatcgtcgattcggtgcagatccatgcggccagcaacggcggcaaggtgatctatacgccgtcgccgcgcatgacccagatctacaccggcaactacggcggcggcatggacgccggcctgctgcacaaggccatgtacgaggtcgtgcagcccaatggcctgctggtgttccgcgacccggcgcgcaccaccggcgcctcgattaccttcgacccggatggcagtggcagcaagctcgaatcgttcccgggccaggacatttacagcaacaacatcatcaccgcgaacggctatcgcgatcctggcgacacgttgaacgtgagcgcgaacgtgagcggcgacatcaacccgggctacctgcgcaccgggcgccagctgcagactttcgtcgacgacgatttcgcgcgctggaacaccgactggcagtccagctacatcaacctggcgcagagcatctacaacgcttccagccgtggcccgcagggcatcggcccggattcggtgcaggactacctcaacgatccgggcatccaggcgctgctgctgtccaagctgcgcctggccgacctggacgtgtccacgctcgacaacgccatgggcgtgatccgcgtgagcaacggtgccacctggcgcaccgccgccaccaccggcgccgacttcatgctggtcgacaacggcaccatcgcactggaaggcggcgcgctgcgtgcgtcggaagtgcgcgtgctgggcgcgggcatgctggtcggccatggcgacgtggccggcaccgcgatggatcttgatgcactgggcagcggttccggcccctcctggcgcgaggacggcttcaaccgcctgcgcgtgtttggcacgctgatgccgcgcggcggcgatctggtcacccacggctacgtcaacatcatgccgggcggcaagctgctgttcgacgtcaccgagaacggcggcgcggccacgggccgactgcgcgtgggcacgttcttcgatgacgaaccgaccgacggcgcgctggtgatctccaagggcgccttcctcgaattgaatgtggcgcagggctactacggccaggacttccgccgtgacctggtgcagggcccgatctaccagggcggcttcgaggatgtcgtgcgcctgggcgacaccggctacagcgccagcatcgccgcgggcgatgtgttccgcccgcgccacaactcgctgctgagtttcaacgtgaagcagaccgccgatggcctgtggctgacggccaaccccggcttcgatcagctgggcctgttcgccaacgccacttccggcgacgggctgggccgcgcgctggcgaccgcctccgcccgccaggacggcaacctgaaatcgctgctgggcgcgctgcagttcgccgaccgtgatgtgatcgcgcagcaggccggtgccctgcgcggtgatgcgcatgccagcctgcgcctggccgacaacgcgctggtcggcagcatcggcaacgtggtgcagcagcaccaggccgcgatgcgcagtggtggtgatgcagatggcctggcctcgcaggccgcgcagtcggtgtcggcacagccgggcatgcgccacggcagcctgttcaaccagctggcgatgcatctggtcgagccggcggccggcggtactgccagcggcagcgaggccgggcgcagccgtggcctgtgggcgcgcggcttcgccagccatggccgcatcgatgcggagggcggcgcggccggcctcagccacaacatcggtggcatcgtggtcggtgccgatacccgcttagctgatgaccgcgtcaccctcggcgtcagcgtggcggcagccgacatgtcgaccaagggccgcgacggctccgacttcagcggtgacgtgcgcgcgctggatgtgggcggctacctggatgcgacctactcgcgcggctacctgtcggcggcagtgcgctataccgacctgcgccacgacacccgccgcagcatcagtggcatcgatggcctgcagcagccgctgcgcgccaagtacaacaacgatgcgatctccgcgcgggtcgagcacgcgttctcgttcaccaccggcacggggctggtgatccagccgttgctgccggtggtggattacgcgcgcacctcggccacgcgcttcaatgaagggcagggcgcgggtgcactggttggccgcagcggcagcctggaaagcatccgcgtcggcgccggcctgcagctgttcaagaccttcgaaggcaacaacggcgagcgcatcaccccgcgtgcccgcgtggtctggcagaaggaactgggcgatttgcaggcacgctacagcaccggcttcgccgccgccccggacctggtgttcggcgccagcagccaggccgtgggtgagcaggtgctggcctggaacctgggcgtgaccagccgcgccagcgaacgcctgtcgatcatggccgactacgtgggcgagcgccgcgacgggcagatccagaacggcgtgatgctgggcctgggctatcggttctaa

SEQ ID NO: 214 - DNA, 2874 bp, Stenotrophomonas Sp.
atgaagtattcgaagttgagcctggccctggccgggctgatgggcgttggcgccatcgcggcagctgatgacgtcatggcaatgagttatcacgtgcaggacgatcgcgtcttcctcagcggcggcgtcaccgtcgccgatgtggtggcgctgcccgcactgctggccaaggcgcaggctgaaggccgtccgatccgcgaagtcgtgctgcgaacgtccaacggtggcgcgctgatcgccggcgagtggctgcaggcggtgatccgtacccagggcctggacaccatcgtgtccggtcactgcatttcgtcctgctcgatcatgcagtccggtggcgtcaaccgttacctcggcggcgatctgccgctggtcgactcggtgcagatccatgccgccagcagtggtggcaggatcacctatgcgccgtcgccgcgcatgacccagatctacacaggcaactacggcggtggcatggatgcgggcctgttgcacaaggccatgtatgaagtggtgcagcccaatggcctgctggtattccgcgacccggcgcgtaccacgggtacgtcggttaccttcgatccggatggcagtgggagcaagctggagtcattcccgggccaggacatccgcagcaacagcatcatcaacacggcgggctatcgcgatccgggcgacacccttcgtgtcaccagcaacgtcagcggcgacatcaacccgggctacctgcgcaccgcgcgccagctgcaggcctttgtcgacgacgatttcgcgcgctggaacaccgactgggccagcacctacatcaactatgcggtgagcctgtacaacttctccacgcggggggcgaacggtatcggcgcgcagtcgttgcagcagctgctcgccgaccccgacctccaggatgaactgcgcggccagctgcggctggccgatctggatgcctcgaccctggccaactccgccggcgtgatccgtgtcagcaatggcgccacctggcgcaccgctgaaaccaccggcgccgatttcattctggtggacaacggcaccatcgcactggagggtggtgcgctgcgcacccccgagctgcgggtgatgccgggcagcatcgtggttggccacggtgatatcgcatcggtcggcaccgacagcgatgcgctgctggatggcaccggcccgtcctaccgcgaagatggcttcaaccgcctgcgcgtgttcggcacgctgatgccgcgcggtggggatctggtgacccacggctacgtcaacatcatgcccggcggccaggtgctgtttgatgttaccgaagccggtggtaccggcagtggccgcctgcgcgtcggcagcttctacgacggcggcaccgaggagggcgcgctggtgatcgcgcagggcgcacaccttgcgttgaatgtggcccagggcttctatgccggtgcctaccgccgcgatctggtggaagggccgatctaccaggggggcttccaggatgtcgtgcggctgggggacgccggatacagtgccagcatcactgccggtgaagagttccgcccgcgccacaattcactgctcagcttcaacgtgaagcagacggccgatggcctgtggctgaccgccaacccgggcttcgaccagctgggcctgtttgccaacggtacgtccggcgacggcctgggccgcgcgctggcgaccgcctccgatcgccaggacaagggactgagatcgctgctgggcgcactgcagttcgccgaccgcgatgtgatcgcacaacaggccggtgctctgcgcggtgatgcgcacgccagcctgcgactggccgacaccgcgctggtgggcagtatcggcaacgtcgtgcagcagcaccagtcggccatgcgcagcggcggtgatgccgatggcctggcctcgcaggtggcgcagtcggtctcctcccagccgggcatgcgccatggcagcctgttcaaccagctggcgatgcacctggtcgagccggcgtcggacagcgttgcgggcagcggtgatgctggacgcagccacggcatctgggcacgtggtttcgccagccatggtcgcatcgatgctgacggtggcgtggccggcctgagccacaccatcggtggcatcgtggtcggtgccgatacccgcgtggccgatgaccgcgtgaccctgggcgtcagcgtggccgcggcggacatgtcgaccaaggccagcgatggctctggtttcactggtgacgtgcgtgcgctggacgtgggcggctacctcgatgcgacgtacgcgcgcggctatctgtcggcggccgtgcgctacaccgatctgcgccacgatacgcgtcgcagcatcaacggcatcgatggcctgcagcagccactgcgcgccaagtacagcaacgatgcgatctccgcacgggtggaacatgcgttctccttcaccaccggcaagggcctggtgatccagccgttgctgccggtggtggactacgcgcgcacctcggccacccgcttcaacgaagggcagggcgccggtgcgctggttggccgcagcggcagcctggagagcatccgcgtgggtgcgggtctgcagctgttcaagaccttcgaaggcaacaacggcgagcgcatcaccccgcgcgcgcgggtggtctggcagaaggaactgggcgattcgcaggcccgctacagcaccggcttcgccgcggcaccggatctggtgttcggcgccagcagccaggcggtgggcgagcaggtgctggcctggaacctgggtgtgaccagccgtgccagcgagcggctgtcgatcatggccgattacgtgggtgagcgccgcgacgggcagatccagaacggcgtgatgctgggcctgggctacaagttctaa

SEQ ID NO: 215 - DNA, 2874 bp, Stenotrophomonas Sp.
atgaagtattcgaagttgagcctggccctggccgggctgatgggcgttggcgccatcgcggcagctgatgacgtcatggcaatgagttatcacgtgcaggacgatcgcgtcttcctcagcggcggcgtcaccgtcgccgatgtggtggcgctgcctgcactgctggccaaggcgcaggctgaaggccgtccgatccgcgaagtcgtgctgcgaacgtccaacggtggcgcgctgatcgccggcgagtggctgcaggcggtgatccgtacccagggcctggacaccatcgtgtccggccactgcatttcgtcctgctcgatcatgcagtccggtggcgtcaaccgttacctcggcggcgatctgccgctggtcgactcggtgcagatccatgccgccagcagtggtggcaggatcacctatgcgccgtcgccgcgcatgacccagatctacacaggcaactacggcggtggcatggatgcgggcctgttgcacaaggccatgtatgaagtggtgcagcccaatggcctgctggtattccgcgacccggcgcgtaccacgggtacgtcggttaccttcgatccggatggcagtgggagcaagctggagtcattcccgggccaggacatccgcagcagcagcatcatcaacacggcgggctatcgcgatccgggtgacacccttcgtgtcaccagcaacgtcagcggcgacatcaacccgggctacctgcgcaccgcgcgccagctgcaggccttcgtcgacgacgatttcgcgcgctggaataccgactgggccagcacctacatcaactatgcggtgagcctgtacaacttctccacgcggggggcgaacggtatcggcgcgcagtcgttgcaacagctgctcgccgaccccgacctccaggatgaactgcgcggccagctgcggctggccgatctggatgcctcgaccctggccaactccgccggcgtgatccgtgtcagcaatggcgccacctggcgcaccgctgaaaccaccggcgccgatttcattctggtggacaacggcaccatcgcactggagggtggtgcgctgcgcacccccgagctgcgggtgatgccgggcagcatcgtggttggccacggtgacatcgcatcggtcggcaccgacagcgatgcgctgctggatggcaccggcccgtcctaccgcgaagatggcttcaaccgcctgcgcgtgttcggcacgctgatgccgcgcggtggggatctggtgacccacggctacgtcaacatcatgcccggcggccaggtgctgttcgatgttaccgaaaccggtggtaccggcagtggccgcctgcgcgtcggcagcttctacgacggcggcgccgaggagggcgcgctggtgatcgcgcagggcgcacaccttgcgttgaatgtggcccagggcttctatgccggtgcctaccgccgcgatctggtggaagggccgatctaccaggggggcttccaggatgtcgtgcggctgggggacgccggatacagtgccagcatcactgctggtgaagtgttccgcccgcgccacaattcactgctcagcttcaacgtgaagcagacggccgatggcctgtggctgaccgccaacccgggcttcgaccagctgggcctgtttgccaacggtacgtccggcgacggcctgggccgcgcgctggcgaccgcctccgatcgccaggacaagggactgagatcgctgctgggcgcactgcagttcgccgaccgcgatgtgatcgcacaacaggccggtgccctgcgcggtgatgcgcacgccagcctgcgactggccgacaccgcgctggtgggcagcatcggcaacgtcgtgcagcagcaccagtcggccatgcgcagcggcggtgatgccgatggcctggcctcgcaggtggcgcagtcggtctcctcccagccgggcatgcgccatggcagcctgttcaaccagctggcgatgcacctggtcgagccggcgtcgggcagcgttgcgggcagcgctgatgctggacgcagccacggcatctgggcacgtggtttcgccagccatggtcgcatcgatgctgacggtggcgtggccggcctgagccacaccatcggtggcatcgtggtcggtgccgatacccgcgtggccgatgaccgcgtgaccctgggcgtcagcgtggccgcggcggacatgtcgaccaaggccagcgatggctctggtttcactggtgacgtgcgtgcgctggacgtgggcggctacctcgatgcgacgtacgcgcgcggctatctgtcggcggccgtgcgctacaccgatctgcgccacgatacgcgtcgcagcatcaacggcatcgatggcctgcagcagccactgcgcgccaagtacagcaacgatgcgatctccgcacgggtggaacatacgttctccttcaccaccgccaagggcctggtgatccagccgttgctgccggtggtggactacgcgcgcacctcggccacccgcttcaacgaagggcagggcgccggtgcgctggttggccgcagcggcagcctggagagcatccgcgtgggtgcgggcctgcagctgttcaagaccttcgaaggcaacaacggcgagcgcatcaccccgcgcgcccgggtggtctggcagaaggaactgggcgattcgcaggcccgctacagcaccggcttcgccgcggcaccggatctggtgttcggcgccagcagccaggcggtgggcgagcaggtgctggcctggaacctgggtgtgaccagccgtgccagcgagcggctgtcgatcatggccgattacgtgggtgagcgccgcgacgggcagatccagaacggcgtgatgctgggcctgggctacaagttctaa

SEQ ID NO: 216 - DNA, 2874 bp, Stenotrophomonas Sp.
atgaagcattcgaagttgagcctggccctggccgggctgatgggcgtcaccgccatggcggcggttgatgacgtcatggcaatgaattatcacgtgcgggacgatcgcgtcttcctcagcggcggcgtcaccgtcgccgacgtggtggcgctgcccgcgctgctggccaaggcacaggctgaaggccgtccgatccgcgaagtcgtgctgcgcacatccaatggtggcgcgctgatcgccggcgagtggctgcaggcggtgatccgcacccagggcctggacaccatcgtgtccggccactgcatctcgtcctgctcgatcatgcagtccggtggcgtcaaccgttacctcggcggcgatctgccactgatcgactcggtgcagatccacgccgccagcagtggcggcaagatcacctatgcgccgtcagcgcgcatgacccagatctacacaggcaactacggcggcggcatggatgcgggcctgttgcacaaggcgatgtatgaagtggttcaacccaatggcctgctggtattccgcgacccggcgcgcaccacgggtacgtcggtcaccttcgatccggatggcagcggcagcaagctggagtcgttcccgggccaggacatccgcggcaacaacatcatcaacacggcaggctatcgcgatccgggcgacaccctccgtgtcaccagcaacgtcagcggcgacatcaacccgggctacctgcgcaccgcgcgccagctgcaggccttcgtcgacgacgatttcgcgcgctggaacaccgactgggccagcacctacatcaacgatgcggtgagcctgtacaacgtctccacgcggggggcgaacggtatcggcgcgcagtcgttgcagcagctgctcgccgatcccgacgtccagaatgaactgcgcggccagctgcggctggccgatctggatgcctcaaccctggccagttcggcgggcgtgatccgtgtcagcaatggcgctacctggcgcaccgccgaaaccactggcgccgacttcattctggtggacaacggcaccatcgcactggagggtggtgcgctgcgcacccccgagctgcgcgtgatgccgggcagcatcgtggtcggccatggtgatatcgcatcggtcggcaccgacagcgatgcgctgctggatggcaccggcccgtcctaccgcgaagacggcttcaaccgcctgcgcgtgttcggcacgttgatgccgcgtggtggcgatctggtgacccacggctacgtcaacatcatgcccggcgggcaggtgctgttcgatgttaccgaaaccggtggtaccggcagtggccgcctgcgcgtcggcagcttctacgatggcggctccgaggagggcgcgctggtgatcgcgcagggcgcacatctggcgctgaacgtggcccagggcttctatgccggcacctatcgtcgcgacctggtggaaggaccgatctaccaggggggcttccaggatgccgtgcggctgggcgatgccggctacagcgccagcatcacggccggtgaagtgttccgcccgcgccacaattcgctgctcagcttcaacgtcaaccagaccgccgacggcctgtggctgaccgccaacccgggcttcgatcagctgggcctgttcgccaacggcacctccggcgacggcctggggcgcgcgctggccgctgcagcggaccgccaggacagcggcctgaagtcgttgctcggcgcgctgcagttcagcgaccgcgatgtgatcgcacagcaggctggcgccctgcgcggtgatgcgcatgccagcctgcgcctggccgacaatgcactgatcggcagcatcggcaacgtggtgcagcagcaccaggcagcgatgcgcagtggcggcgatgcagacgggttggcttcgcaggcggcgcagtcggtgtcggcgcagccgggcatgcgccatggcagcctgttcaaccagctggccatgcatctggtcgagccggcgggcgaggctgctggcgacagccgggtggcggggcgcagccatggcctgtgggcacgcggtttcgccagccatggccgcatcgatgccgacggcggcgtggccggcctgagccataacatcggcggcatcgtggtcggtgccgacacccgcgtggccgatgaccgcgtgaccctgggcgtcagcgtggccgcggcggacatgtcgaccaaggcaagcgatggctccggtttcagtggcgacgtacgcgcgctggatgtgggcggctacctggatgcgacctattcgcggggctacctgtcggctgccgtgcgctacaccgacctgcggcatgacacccgccgcagtgtcggcggcattgatgggctgcagcagcctctgcgcgcgaagtacagcaacgatgccatctcggcacgggtggggcatgcgttctccttcaccactggaaagggtctggtgatccagccgctgctgccggtggtggactacgcacggacctcggccacccgtttcaatgaagggcagggcgccggtgcgctggtgggccgcagcggcagcctggagagcattcgtgtgggtgccggcctgcagctgttcaagaccttcgaaggcaacaacggtgagcgcattaccccgcgtgcccgcgtggtctggcagaaggagctgggcgattcgcaggcgcgctacagcaccggctttgctgcggccccggacctggtgtttggtgccagcagccaggccgtgggcgagcaggtgctggcctggaacctgggcgtgaccagccgtgccagcgagcgcctgtcgatcatggccgactacgtgggtgagcgccgcgacgggcagatccagaacggcgtgatgctgggcctgggctaccggttctaa

SEQ ID NO: 217 - DNA, 2874 bp, Stenotrophomonas Sp.
atgaagcattcgaagttgagcctggccctggcagcgttgctgggcatcaccgccatggcggcggttgatgacgtcatggcaatgaattatcacgtgcaggacgatcgcgtcttcctcagcggcggcgtaaccgttgccgatgtggtggcgctgcccgcgctgctggccaaggcgcaggccgaaggacgcccgatccgcgaagtcgtgctgcgcacgtccaacggtggcgcgctgatcgccggcgagtggctgcaggcggtgatccgcacccagggcctggacacgatcgtgtccggccactgcatttcgtcctgctcgatcatgcagtccggcggcgtcaaccgttatctcggcggcgacctgccgctggtcgattcggtgcagatccatgccgccagcagtggtggcaggatcacctacgcaccgtcgccgcgcatgacccagatctacaccggcaactatggcggcggcatggatgccggcctgctgcacaaggccatgtatgaggtggtgcggcccaatggcctgctggtgttccgcgacccggcgcgcaccacgggtacctcggtcaccttcgatccggatggcagcggcagcaagctggagtccttccctggccaggacatccgcggcaacaacatcatcaacacggcaggctatcgcgatccgggcgacaccctgcgtgtcaccagcaacgtcagcggcgacatcaatccgggctacctgcgcaccgcgcgccagttgcaggctttcgtcgacgacgatttcgcgcgctggaacaccgactgggccagcacctacatcaactacgcggtgagcctgtacaacgtctccacgcggggaccgaacggcatcggcacgcagtcgctgcagcagctgcttgccgaccccgacctccaggatgagctgcgcggccagttgcggctggccgatctggatgcgtccaccctggcaggttcggcgggcgtgatccgtgtcagcaatggcgccacctggcgcaccgccgaaaccaccggcgccgatttcatgctggtcgacaacggcaccatcgcgctggagggcggcgcgctgcgcacccccgagctgcgggtgatgccgggcagcgtcgtggtcggccacggtgatatcgcatcggtcggtaccgacagcgatgcgttgctggatggcaccggcccgtcctggcgcgaagacggcttcaaccgcctgcgcgtgttcggcacgctgatgccgcgtggcggtgatctggtgacccacggctacgtcaacatcatgcccggcgggcaggtgctgttcgatgttaccgaggccggtggcaccggcagtggtcgcctgcgtgtcggcagcttctacgatggcggtgccgaagagggggcgctggtgatcgcgcagggcgcacacctggcgttgaacgtcgcccagggcttctatgccggcggctaccgccgcgatctggtggaagggccgatctaccagggcggtttccaggatgccgtgcgactgggcgacaccggctacagcgccagcatcaccgcgggcgaagtattccgcccgcgccacaattcgctgctgagcttcaacgtcaaccagacggccgacgggctgtggctgaccgccaacccgggcttcgatcagctgggcctgtttgccaacggcacctccggcgatggactggggcgcgcgctggcagccgcatcggatcgccaggacagcggcctgaagtcgctgctcggcgcactgcagttcgccgaccgcgatgtgatcgcacagcaggccggcgccctgcgcggtgatgcacacgccagcctgcgcctggccgacaatgcactgctgggcagcatcggcaacgtggtgcagcagcaccagacggcgatgcgcagtggcggcgatgccgatggcctggcctcgcaggcggcgcagtcggtgtcggcgcagccgggcatgcgccatggcagcctgttcaaccggctggccatgcatctggtcgagccggccggcgaggctgctggcgacagccgcgcggcgggtggcagccgtggcctgtgggcgcgcggtttcgccagccatggccgcatcgacgccgacggtggcgtggccggcctgagccataacatcggcggcatcgtggtaggtgccgacacgcacgtggccgatgaccgcgtcaccctcggcgtcagcgtggccgccgcggacatgtcgaccaaggccagcgatggctccggtttcagtggcgacgtgcgcgcgctggatgtgggcggctacctggatgcgacctattcgcgtggctacctgtcggcggccgtgcgctacaccgacctgcgccacgatacccgccgcagcctttcgcccatcgatggcctgcaacagccgctgcgtgcccgatacagcaacgatgcgatctcggcgcgggtcgaacacgcgttctccttcaccaccggcaagggactggtgatccagccgctgctgccggtggtggattacgcgcggacctcggccacccgcttcaacgaagagcagggcgctggcgcgctggtggggcgcagcggcagcctggagagcatccgcgtgggtgccggcctgcagctgttcaagaccttcgagggcaacaacggcgagcgcatcaccccgcgtgcccgcgtggcctggcagaaggagctgggcgattcacaggcgcgctacagcaccggttttgctgcggccccggacctggtgtttggtgccagcagccaggccgtgggcgaacaggtgctggcctggaacgtgggcgtgaccagtcgcgccagcgagcgcctgtcgatcatggccgactacgtgggtgagcgccgcgacgggcagatccggaacggcgtgatgctgggcctgggctaccggttctaa

SEQ ID NO: 218 - DNA, 2889 bp, Stenotrophomonas Sp.
atgaagcattcgaagttgagcatcgccctggcaggcctggtgggtatcgcgaccctgggccagatggatgacgtcatggcaatgaattatcacgtgcagggcgatcgcgtcgtgctgagtggcggtgtcaccgtcgccgacgtcgtcgcgctgccggcgctgctggccaaagcgcaggccgaaggccgcccgatccgcgaagtcgtgctgcgcacctccaatggtggcgcgctgatcgcgggtgagtggctgcagggcgtgatccgcaccaacggcctgaataccatcgtgtccggccactgcatctcgtcctgctcgatcatgcagtccggtggcgtcgaacgttacctggccggcgacctgccgctggtcgactcggtgcagatccacgctgccagcaacagtggcaaggtgatctacacgccgtcgccgcggatgaccgagatctacaccggcaactacggcggcggcatggatgccggcctgctgcacaaggccatgtacgaggtggtgcagcccaacggcctgctggtgttccgcgacccggcccggaccaccggcgcttcggtcagcttcgatcccgatggcagcggccgcaggctggagaccttccccggccaggacatctacagcaacaacatcatcaccgccgccggttaccgcgatccgggcgataccctgacggtcaccggtaatgtcagcggcgacatcaatccaggctacctgcgcactgcgcgccagctgcaggcgttcgtcgatgacgacttcgcgcgctggaacgataccgacttcgccaccacgtacatcaactatgcggtgaacatctacaaccgctccagcgccggcccgaacggcatcggcccggcttcggtgcaggattacctcaacgatccgggtacacagcagctccttctgggccagctgcgcctggatgaactggacgcttccacgctgggcaattcggctggcgtgatccgcgtcgccaagggcggcacctggcgcaccgccgaaaccaccggcgccgatttcatgctggtggagaacggcaccatcgccctggaaggcggcgcgttgcgcacgccggagctgcgcgtactggcggccggcatggtggtcggccacggcgacatcgcctcggttgccaccgactcgagcgcactgctcaatggcaccggcccgtcgtaccgcgaggatggcttcaaccgcctgcgcgtgtacggcaccctgatgccgcgtggtggtgacctggttacccatggctacgtcaacatcatgccgggcggcaaggtgctgttcgacgtgactgaagccggcggctccgaggccgggcgcctgcgtgtgggcgacttctacgacagcggcgccaacgagggtgcgctggtcatctcgccgggcgcccaccttgaactgaacgtggcgcagggcttctacgccggcaactaccagcgtgagctggtgagcggcccgatctaccagggcggtttcaccgatgcggtgcgcctgggtgacaccggctatacggccagcatcaccgacggcgaggtgttccggccgcgccacaattcgctgctgagcttcaacatcaaccagaccgccgagggcctgtcgctgaccgccaaccccggcttcgaccagctcgcgcagcttaccggcaacaatggcaacgatggactcggtcgcgcgctggccactgccggccagcgccaggatgccgggctgaagccgctgctgggggcgctgcagttcgctgaccgcgatgtgatcgcccagcaggccggtgcactgcgcggtgatggccatgccagcctgcgcctggccgacagcgcgctggttggcagcatcggcagcgtggtgcagcagcaccaggccgcacggcgcagcggcagcggtgatgccggtggtttggccgcacaggccgcgcaggcggcgtcggcgcagccgggcatggccaatggcagcctgttcaaccagttggcgatgcatctggtggagccggcggggacgggcggtggcagcaccaacttcgccggcgaagcgccgcgcagccacggcctctggggccggggcttcggcagccatggccgcatcgatggcgagggcggcgtggccggcctgagccataccgtcggcggcatcgtgctcggtgccgatacgcagctggccgatgaccgggtgacgctgggcgtcagcgttgccgccgcggacatgtcgaccaagggccgcgatggttccggtttcagcggcgacgtgcgcgcgctggatgtgggcggctacctggatgccacctactcgcgtggctacctgtcggcctcggtgcgctataccgatctgcgccacgacacccgccgcagcatcgatggcatcgacggcctgcagggtccgttgcgtgccaagtacaacaacgatgcgatctcggcccggctggagcacggcttctcgttcaccaccgccaagggcgtagtgatccagccgctgctgccggtggtcgattacgcgcgcacctcggccacccgtttcaatgaagggcagggtgccggcgcactggtggggcgtggtgacagcctggaaagcatccgcgttggtgcgggcctgcaggtgttcaagaccttcgaaggcaacaacggcgagcgcatcaccccgcgcgcgcgcgttgtctggcagaaggaactgggcgacacccaggcccgttacagcaccggcttcgccgcggcgccggacctggtgttcggtgccagcagccagaccgtgggcgagcaggtgctggcctggaacctgggtgtgaccagccgcgccaccgatcgcctgtcggtgatggtcgactacgtgggcgagcgccgcgacggccagctgcagaacggcgtgatgctgggcctgggctatacgttctaa

SEQ ID NO: 219 - DNA, 2889 bp, Stenotrophomonas Sp.
atgaagcattcgaagttgagcatcgccctggcaggcctggtgggtatcgcgaccctgggccagatggatgacgtcatggcaatgaattatcacgtgcagggcgatcgcgtcgtgctgagtggcggtgtcaccgtcgccgacgtcgtcgcgctgccggcgctgctggccaaagcgcaggccgaaggccgcccgatccgcgaagtcgtgctgcgcacctccaatggtggcgcgctgatcgcgggtgagtggctgcagggcgtgatccgcaccaacggcctgaacaccatcgtgtccggccactgcatctcgtcctgctcgatcatgcagtccggtggcgtcgaacgttacctggccggcgacctgccgctggtcgactcggtgcagatccacgctgccagcaacagtggcaaggtgatctacacgccgtcgccgcggatgaccgagatctacaccggcaactacggcggcggcatggacgccggcctgctgcacaaggccatgtacgaggtggtgcagcccaacggcctgctggtgttccgcgacccggcccggaccaccggcgcttcggtcagcttcgatcccgatggcagcggccgcaggctggagaccttccccggccaggacatctacagcaacaacatcatcaccgccgccggttaccgcgatccgggcgataccctgacggtcaccggcaatgtcagcggcgacatcaatccaggctacctgcgcactgcgcgccagctgcaggcgttcgtcgatgacgacttcgcgcgctggaacgataccgacttcgccaccacgtacatcaactatgcggtgaacatctacaaccgctccagcgccggcccgaacggcatcggcccggcttcggtgcaggattacctcaacgatccgggtacacagcagctccttctgggccagctgcgcctggatgaactggacgcttccacgctgggcaattcggctggcgtgatccgcgtcgccaagggcggcacctggcgcaccgccgaaaccaccggcgccgatttcatgctggtggagaacggcaccatcgccctggaaggcggcgcgttgcgcacgccggagctgcgcgtgctggcgggcggcatggtggtcggtcacggcgacatcgcctcggttgccaccgactcgagcgcactgctcaatggcaccggcccgtcgtaccgcgaggatggcttcaaccgcctgcgcgtgtacggcaccctgatgccgcgtggtggtgacctggttacccatggctacgtcaacatcatgccgggcggcaaagtgctgttcgacgtgactgaagccggcggctcccaggccgggcgcctgcgtgtgggcgacttctacgacagcggcgccaacgagggtgcgctggtcatctcgccgggcgcccaccttgaactgaacgtggcgcagggcttctacgccggcaactaccagcgtgagctggtgagcggcccgatctaccagggcggtttcaccgatgcggtgcgcctgggtgacaccggctatacggccagcatcaccgacggcgaggtgttccggccgcgccacaattcgctgctgagcttcaacatcaaccagaccgccgagggcctgtcgctgaccgccaaccccggcttcgaccagctcgcgcagcttaccggcaacaatggcaacgatggactcggtcgcgcgctggctactgccggccagcgccaggatgccgggctgaagccgctgctgggggcgctgcagttcgctgaccgcgatgtgatcgcccagcaggccggtgcactgcgcggtgatggccatgccagcctgcgcctggccgacaacgcgctggttggcagcatcggcagcgtggtgcagcagcaccaggccgcacggcgcagcggcagcggtgatgccggtggcttggccgcacaggccgcgcaggcggcgtcagctcagccgggcatggccaatggcagtctgttcaaccagttggcgatgcatctggtggagccggcgggggcggtcggtggcagcaccaacttcggcggcgaagtgccgcgcagccacggcctctggggccgcggtttcggcagccatggccgcatcgatggcgagggcggcgtggccggcctgagccataccgtcggcggcatcgtgctcggtgccgatacgcagctgaccgatgaccgggtgacgctgggcgtcagcgttgccgcggcggacatgtcgaccaagggccgcgatggttccgggttcaccggcgacgtgcgtgcgctggatgtgggcggctacctggatgccacttactcgcggggttacctgtcggcctcggtgcgctacaccgacctgcgccacgacacccgccgcagcatcgatggcatcgacggcctgcagggtccgttgcgtgccaagtacaacaacgatgcgatctcggcccggctggagcacggcttctcgttcaccaccgccaatggcgtggtgatccaaccgctgctgccggtggtcgattacgcgcgcacctcggccacccgtttcaatgaagggcagggggccggcgcactggtggggcgtggtgacagcctggaaagcatccgcgtcggtgcgggcctgcaggtgttcaagaccttcgaaggcaacaacggcgagcgcatcaccccgcgcgcgcgcgttgtctggcagaaggaactgggcgacacccaggcccgttacagcaccggcttcgccgctgcgccggacctggtgttcggtgccagcagccagaccgtgggcgagcaggtgctggcctggaacctgggtgtgaccagccgcgccaccgatcgcctgtcggtgatggtcgactacgtgggcgagcgccgcgacggccagctgcagaacggcgtgatgctgggcctgggctatacgttctaa

SEQ ID NO: 220 - DNA, 2874 bp, Stenotrophomonas Sp.
atgaagcattcgaagttgagcctggccctggcagcgttgctgggcatcaccgccatggcggcggttgatgacgtcatggcaatgaattatcacgtgcgggacgatcgcgtcttcctcagtggcggcgtaaccgttgccgatgtggtggcgctgcccgcgctgctggccaaggcgcaggccgaaggacgcccgatccacgaagtcgtgctgcgcacgtccaacggtggcgcgctgatcgccggcgagtggctgcaggcggtaatccgcacccagggcctggacacgatcgtgtccggccactgcatttcgtcctgctcgatcatgcagtccggcggcgtcaaccgttatctcggcggcgacctgccactggtcgattcggtgcagatccatgccgccagcagtggtggcaggatcacctacgcaccgtcgccgcgcatgacccagatctacaccggcaactatggcggcggcatggatgccggcctgctgcacaaggccatgtatgaggtggtgcggcccaatggcctgctggtgttccgcgacccggcgcgcaccacgggtacctcggtcaccttcgatccggatggcagcggcagcaagctggagtccttccctggccaggacatccgcggcaacaacatcatcaacacggcaggctatcgcgatccgggcgacaccctgcgtgtcaccagcaacgtcagcggcgacatcaatccgggctacctgcgcaccgcgcgccagttgcaggccttcgtcgacgacgatttcgcgcgctggaacaccgactgggccagcacctacatcaactacgcggtgagcctgtacaacgtctccacgcgggggccgaacggcatcggcacgcagtcgctgcagcagctgcttgccgaccccgacctccaggatgagctgcgcggccagttgcggctggccgatctggatgcgtccaccctggcaagttcggcgggcgtgatccgtgtcagcaacggcgccccctggcgcaccgccgaaaccaccggcgccgatttcatgctggtcgacaacggcaccatcgcgctggagggcggcgcgctgcgtacccccgagctgcgggtgatgccgggcagcgtcgtggttggccatggcgatatcgcatcggtcggcaccgacagtgatgcgttgctggatggcaccggcccgtcctaccgcgaagacggcttcaaccgactgcgcgtgttcggcacgctgatgccgcgtggcggtgatctggtgacccacggctacgtcaacatcatgcccggcgggcaggtgctgttcgatgttaccgaggccgggggcaccggcagtggccgcctgcgcgtcggcagcttctacgatggcggggccgaagagggggcgctggtgatcgcgcagggcgcacacctggcgttgaacgtcgcccagggcttctatgccggcggctaccgccgcgatctggtggaagggccgatctaccagggcggtttccaggatgccgtgcgactgggcgacaccggctacagcgccagcatcaccgcgggcgaagtattccgcccgcgccacaattcgctgctcagcttcaacgtcaaccagaccgccgacgggctgtggctgaccgtcaacccgggcttcgatcagctgggcctgtttgccaacggcacctccggcgatggactggggcgcgcgctggcagccgcatcggatcgccaggacagcggcctgaagtcgctgctcggcgcactgcagttcaccgaccgcgatgtgatcgcacagcaggccggcgccctgcgcggtgatgcacacaccagcctgcgcctggccgacaatgcactgctgggcagcatcggcaacgtggtgcagcagcaccaggcggcgatgcgcagtggcggcgatgccgatggcctggcctcgcaggcggcgcagtcggtctcggcgcagccgggcatgcgccatggcagcctgttcaaccagttggccatgcatctggtcgagccggccggcgaggctgctggcgacagccgcgcggcgggtggccgccgtggcctgtgggcgcgcggttttgccagccatggccgcatcgatgccgacggtggcgtggccggcctgagccataacatcggcggcatcgtggtcggtgccgacacgcacgtggccgatgaccgcgtcaccctcggcgtcagcgtggccgccgcggacatgtcgaccaaggccagcgatggctccggtttcagtggcgacgtgcgcgcgctggatgtgggcggctacctggatgcgatctattcgcgtggctacctgtcggcggccgtgcgctacaccgacctgcgccacgatacccgccgcagcctttcggccatcgatggcctgcaacagccactgcgcgcccgatacagcaacgacgcgatctcggcgcgggtggagcatgcgttctccttcaccaccggcaagggactggtgatccagccgctgctgccggtggtggactacgcgcggacctcggctacccgcttcaacgaagggcagagcgctggcgcgctggtggggcgcagcggcagcctggagagcatccgcgtgggcgccggcctgcagctgttcaagaccttcgagggcaacaacggcgagcgcatcaccccgcgtgcccgcgtggtctggcagaaggagctgggcgactcgcaggcgcgctacagcaccggtttcgccgcagccccggacctggtgttcggtgccagcagccaggccgtgggcgagcaggtgctggcctggaatgcaggcgtgaccagtcgcgccagcgagcgcctgtcgatcatggccgactacgtgggtgagcgccgcgacgggcagatccagaacggcgtgatgctgggcctgggctaccggttctaa

SEQ ID NO: 221 - DNA, 2991 bp, Stenotrophomonas Sp.
atggcccctgattccattgtgaatgcattcatgtttcgggggctggtgcgctgggggagtttgcgccgcccggacgttgaactcctgacccgtgtgttgcgggtggagagagaacacatgaagcattcgaagttgagcctggccctggccgggctgatgggcatcaccgccatggcggcggttgatgacgtcatggcaatgaattatcacgtgcgggacgatcgcgtcttcctcagcggcggcgtgaccgtcgccgacgtggtggcgctgcccgcgctgctggccaaggcacaggctgaaggccgtccgatccgcgaggtcgtgctgcgcacatccaatggtggcgcgctgatcgccggcgagtggctgcaggcggtgatccgcacccagggcctggacaccatcgtgtccggccactgcatctcgtcctgctcgatcatgcagtccggtggcgtcaaccgttacctcggcggcgatctgccactggtcgactcggtgcagatccatgccgccagcagtggcggcaagatcacctatgcgccgtcagcgcgcatgacccagatctacacaggcaactacggcggcggcatggatgcgggcctgttgcacaaggcgatgtatgaagtggttcaacccaatggcctgctggtattccgcgacccggcgcgcaccacgggtacgtcggtcaccttcgatccggatggcagcggcagcaaggtggagtcgttcccgggccaggacatccgcggcaacaacatcatcaacacggcaggctatcgcgatccgggcgacaccctccgtgtcaccagcaacgtcagcggcgacatcaacccgggctacctgcgcaccgcgcgccagctgcaggccttcgtcgacgacgatttcgcgcgctggaacaccgactgggccagcacctacatcaactacgcggtgagcctgtacaacgtctccacgcgggggccgaacggcatcggcacgcagtcgctgcaacagctgctcgccgatcccgacctccaggaagagctgcgcggccagttgcggctggccgatctggatgcgtccaccctggccagttcggcgggcgtgatccgtgtcagcaacggcgccacctggcgcaccgccgaaaccaccggcgccgatttcattctggtggacaacggcaccatcgcactggagggtggtgcgctgcgcacccccgaactgcgggtgatgccgggcagcatcgtggtcggccacggtgatatcgcatcggtcggcaccgacagcgatgcgttgctggatggcaccggcccgtcctaccgcgaagacggcttcaaccgcctgcgcgtgttcggcacgctgatgccgcgtggtggtgatctggtgacccacggctacgtcaacatcatgcccggcgggcaggtgctgttcgacgttaccgaaaccggtggtaccggcagtggccgcctgcgcgtgggcagcttctacgatggcggctccgaggagggcgcgctggtgatcgcgcagggcgcacacctggcgttgaacgtcgcccagggcttctatgccggcacctaccgtcgcgacctggtggaaggaccgatctaccaggggggcttccaggatgccgtgcggctgggcgatgccggctacagcgccagcatcacggccggtgaagtgttccgcccgcgccacaattcgctgctcagcttcaacgtcaaccagaccgccgatggcctgtggttgaccgccaatccaggcttcgaccagctgggcctgttcaccaacggcacctccggcgacggcctggggcgcgcgctggccgctgcatcggaccggcaggacagcggcctgaagtcgttgctcggcgcgctgcagttcgctgaccgtgatgtgatcgcacagcaggctggcgccctgcgcggtgacgcgcacgccagcctgcgcctggccgacaatgcactgatcggcagcatcggcaacgtcgtgcagcagcaccagtcggcgatgcgcagtggcggcgatgcagacgggttggcttcgcaggcggcgcagtcggtctcagcgcagccgggcatgcgccatggcagcctgttcaatcagctggccatgcatctggtcgagccggcgggcgaggctgctggcgacagccgggtggcggggcgcagccatggcctgtgggcacgcggtttcgccagccatggccgcatcgatgccgacggcggcgtggccggcctgagccacaacatcggtggcatcgtggtcggtgccgacacccgcgtggccgatgaccgtgtcacgctgggggtcagcgtggccgcggcggacatgtcgaccaaggccagcgatggctccggtttcagtggcgacgtacgcgcgctggatgtgggcggctatctggatgcgacctattcgcgtggctacctgtcggcggccgtgcgctacaccgacctgcggcatgacacccgccgcggtgtcggcggcattgatgggctgcaacagccgctgcacgcccgatacagcaacgatgcgatctccgcacgtgttgaacatgcgttctcgttcaccaccggcaagggactggtgatccagccgctgctgccggtggtggactacgcgcggacctcggccacccgcttcagtgaagggcagggcgccggtgcgctggttggccgcagtggcagcctggagagcattcgtgtgggtgcgggcctgcagctgttcaagaccttcgaaggcaacaacggcgagcgcatcaccccgcgcgcgcgcgtggtctggcagaaggaactgggtgacacccaggcccgctacagcaccggcttcgccgcagctccggacctgctgttcggtgccagcagccaagccgtgggtgagcaggtgctggcctggaacctgggcgtgaccagccgtgccagcgagcgcctgtcgatcatggccgactacgtgggcgaacgccgcgatgggcagatccagaacggcgtgatgctgggcctgggctaccggttctaa

SEQ ID NO: 222 - DNA, 2991 bp, unknown
  environmental sample
atggtccatgatttcattgtgaatgcattcatgtttcgagggccggtgcgctgggggagatcgcgccacccggacgttgaactcctgacccgtgtgttgcgggtggagagagaacacatgaagcattcgaagttgagcctggccctggcagggctgatgggcatcaccgccatggcggcggttgatgacgtcatggcaatgaattatcacgtgcaggacgatcgcgtcttcctcagcggcggcgtcaccgttgccgatgtggtggcgctgcctgcactgctggccaaggcgcaggctgaaggccgtccgatccgtgaagtcgtgctgcgtacgtccaacggtggcgcgctgatcgccggcgagtggctgcaggcagtgatccgtacccagggcctggacaccatcgtgtccggtcactgcatttcgtcctgctcgatcatgcagtccggcggcgtcaaccgttatctcggcggcgatctgccgctggtcgattcggtgcagatccatgctgccagcagtggtggcaggatcacctacgctccgtcgccgcgcatgacccagatctacaccggcaactatggcggcggcatggatgccggcctgttgcacaaggccatgtacgaagtggtggcgcccaacggcctgctggtgttccgcgacccggcgcgtaccacgggtacatcggtcaccttcgatccggatggcagcggcagcaagctggagtcgttcccgggccaggacatccgcggcaacaacatcatcaacacggcaggctaccgtgatccgggcgacaccctccgtatcaccagtaacgtcagtggcgacatcaacccgggctacctgcgcaccgcgcgccagctgcaggccttcgtcgatgacgatttcgcgcgctggaacaccgactgggccagcacctacatcaattacgcggtgagcctgtacaacgtctccacgcgggggccgaacggcatcggcgcacagtcgctgcagcagctgctcggcgaccccgacctccaggatgagctgcgcggccagctgcggctggccgatctggacgtttcgaccctggccaattccgccggcgtgatccgtgtcagcaatggcgccacgtggcgcaccgccgaaaccaccggcgccgatttcatgctggtcgataacggcaccatcgcactggagggcggtgcgctgcgcacccccgagctgcgggtgatgccgggcagcgtcgtggtcggtcacggtgatatcgcatcggtgggcatcgacaccgatgcactgctggatggcaccggcccctcctggcgcgaggacggcttcaaccgcctgcgcgtgttcggcacgttgatgccgcgcggcggtgatctggtgacccacggctacgtcaacatcatgcccggcggccagctgctgttcgacgttaccgaggccggtggcaccggcagtggccgcctgcgcgtcggcagcttctacgatgacggtgccgaggagggcgcgctggtgatcgcgcagggtgcacacctggcgttgaatgttgcccagggcttctatgccggtgcctaccgccgcgacctggtggaagggccgatctaccagggcggcttccaggatgtcgtgcggctgggcgatgccggctacagcgccagcatcaccggcggtgaagtgttccgcccgcgccacaattcgctgctcagcttcaacgtcaaccagacggccgatggcctgtggctgaccgccaacccgggcttcgaccagctggggctgtttgccaacggcacctccggcgacgggctggggcgcgcgctggcagccgcatcggaccgccaggacagcggcctgaagtcgctgctcggcgcgctgcagttcaccgaccgcgatgtgatcgtacagcaggccggcgccctgcgcggtgatgcccatgccagcctgcgcctggccgacaacgcactgctgggcagcatcggcaacgtggtgcagcagcaccaggcggcgatgcgcagtggcggcgatgccgatggactggcttcgcaggcggcgcagtcggtctcggcgcagccgggcatgcgtcatggcagcctgttcaaccagttggccatgcatctggtcgaaccggccggcgaggggactggcggtggcggtgcgacgggacgcagccatggcctgtgggcacgcggtttcgccagccatggccgcatcgacgccgacggtggcgtgggcggcctgagccacaacatcggtggcatcgtggtcggtgccgacacccgcctggccgatgaccgcgtcaccctgggtgccagcgtggccgcggccgacatgtcgaccaaggccagcgatggctccggcttcagcggcgacgtgcgcgcgctggacgtgggcggctacctggacgcgacctattcgcgtggctacctgtcagcggccgtgcgctacaccgatctgcgccatgacacccgccgcagcctctccgccatcgagggcctgcagcagccgctgcgtgcccgatacagcaacgatgcgatctcggcgcgggtcgaacatgccttctccttcaccactggcaaggggctggtgatccagccgctgctgccggtggtggactacgcacggacgtcggcaacccgcttcaacgaagggcagggtgccggtgcgctggccggtcgcagcggcagcctggaaagtatccgcgtgggtgccggcctgcagttgttcaagaccttcgagggcaacaacggcgagcgcatcactccgcgtgcccgcgtggtctggcagaaggagctgggcgattcgcaggcgcgctacagcaccggtttcgccgcagccccggacctggtgtttggtgccagcagccaggccgtgggcgagcaggtgctggcctggaacgtgggcgtgaccagtcgcgccagcgagcgcctgtcgatcatggccgactacgtgggcgagcgccgcgacgggcagatccagaacggcgtgatgctgggcctgggctatcggttctaa

SEQ ID NO: 223 - DNA, 2424 bp, unknown
  environmental sample
accggcaattacggtggcggcatggatgcgggcctgctgcacaaggccatgtatgaggtggtgcagcccaatggcctgctggtattccgcgacccggcgcgcaccacgggtacgtcggtcaccttcgacccggatggcagcggcagcaagctggagacgttcccgggccaggacatccgcggcaacaacatcatcaacacggcaggctatcgcgatccgggcgacaccctccgtgtcaccagcaacgtcagcggcgacatcaacccgggctacctgcgcaccgcgcgccagctgcaggccttcgtcgacgacgatttcgcgcgctggaacaccgactgggccagcacctacatcaactacgcggtgagcctgtacaacgtctccacgcggggcccgaacggcatcggcacgccgtcgctgcaacagatgctcgccgatcccgacctccaggatgagctgcgcggccagttgcggctggccgatctggatgcgtccaccctggcaagttcggcgggcgtgatccgtgtcagcaacggcgccacctggcgcaccgccgaaaccaccggcgccgatttcatgctggtcgacaacggcaccatcgcgctggagggcggcgcgctgcgtacccccgagctgcgggtgatgccgggcagcgtggtggttggccatggcgacatcgcatcggtcggcaccgacagcgatgcgttgctggatggcaccggcccgtcctaccgcgaagacggcttcaaccgcctgcgtgtgttcggcacgctgatgccgcgtggcggtgatctggtgacccacggctacgtcaacatcatgcccggcgggcaggtgctgttcgacgttaccgaaacgggtggtaccggcagtggccgcctgcgcgtcggcagcttctacgatggcggctccgaggagggcgcgctggtgatcgcgcagggcgcacacctggcgttgaacgtcgcccagggcttctatgccggcacctaccgtcgcgacctggtggaaggaccgatctaccaggggggcttccaggatgccgtgcgactgggcgacaccggctacagcgccagcatcgctgccggtgaagtgttccgcccgcgccacaattcgctgctcagcttcaacgtcaaccagaccgccgacggcctgtggctgaccgccaatccaggcttcgaccagctgggcctgttcaccaacggcacctccggcgacggcctggggcgcgcgctggccgctgcatcggaccgccaggacagcggcctgaagtcgctgctgggtgcgctgcagttcgctgaccgtgatgtgatcgcacagcaggccggcgccctgcgcggtgacgcgcacgccagcctgcgactggccgacaatgcactgatcggcagcatcggcaacgtcgtgcagcagcaccaggcagcgatgcgcagtggtggtgatgcagacgggttggcttcgcaggctgcgcagtcggtctcgtcgcagccgggcatgcgccacggcagcctgttcaaccagttggccatgcatctggtcgagccggccggcgagggtcctggcgacagccgcacggcgagtggcagccgtggcctgtgggcgcgcggtttcgccagccatggccgcatcgatgccgacggcggcgtggccggcctgagccacaatgtcggcggcatcgtgatcggtgccgatacccgcgtcgccgatgaccgcgtgaccctcggcgtgagcgtggccgcggccgacatgtcgaccaaggccagcgatggctccggcttcagcggtgacgtgcgcgcgctggacgtggggggctatctggacgcgacctattcgcggggctacctgtcggcagccgtgcgctacaccgacctgcggcatgacacccgccgcagtgtcggcggcattgatgggctgcagcagcctctgcgcgcgaagtacagcaacgacgcgatctcggcgcgggtggagcatgcgttctccttcaccactggaaagggtctggtgatccagccgctgctgccggtggtggactacgcacggacctcggccacccgtttcaatgaagggcagggcgccggtgcgctggtgggccgcagcggcagcctggagagcgttcgtgtgggtgccggcctgcagctgttcaagaccttcgaaggcaacaacggcgagcgcatcaccccgcgcgcgcgcgtggtctggcagaaggaactgggtgacacccaggcccgctacagcaccggcttcgccgcagctccggacctgctgttcggtgccagcagccaggccgtgggcgagcaggtgctggcctggaacctgggcgtgaccagccgtgccagcgaacgcctgtcgatcatggccgactacgtgggcgagcgccgcgatggccagatccacaacggcgtgatgctgggcctgggctaccggttctaa

SEQ ID NO: 224 - DNA, 2886 bp, unknown
  environmental sample
atgaagcagtccaagttgagtctggccctggccggcctgattggtgttggcgtcatggtcaaggctgatgacgccatggcaatgaactatcacgtgcagggagaccgcatcttcctcagcggtggcgtcaccttcgccgacgtcgtttcgctgccggcgctgctggccaaggcgcaggccgaggggcggccgatccgggaggtggtgctgcgtacctccaacggtggcgcgctgatcgccggcgagtggctgcagggggtgatccgcacgtccggcctgaacaccatcgtatcgggccactgcatctcgtcctgctcgatcatgcagtccgggggcgtggagcgctatcttgccggtgatctgccgattgtcgattcggtggagatccatgcggccaacaacggcagcaatgtgatctacgagccgtcgccgcgcatgacccagatctacaccggcaactatggcggcggcatggatgctgggctgctgcacaaggcgatgtacgaagtggtcaagcccaacggcctgctggtgttccgcgatcctgcgcgcacccccggtacgtcggtcacgttcgatccggatggcagcggcagcgcgctggagtcgttccctgggcaggacattcacagcaaccggatcatcaccgcaaccggctatcgtgatccgggcgatacgttgaatgtcactgcggacgtcaccggtgacatcaatccgggctacctgcggtcgggacgccagctgcagaccttcgtcgatgatgacttcgcgcgctggagcaccgaccggccgtcggcgtacttttcctacgcactgaccatctacaacctttccagcacgggtccgcagggcatcggcgctggttcggtgcaggattatctgagcgatcccggcgtgcaggccctgctgctgtccaagcttcggctgggcgatctggacgcgtccacgctggacgattcgatgggcgtgatccggattgccaatggcgctgtctggcgctcgtccgcaaccaccggtgcggacttcatgctggtcgacaatggcaccatcgccctggaaggtggcgccctgcgtgccccggaagtgcgtgtgctcggtgcgggcatgctggtcggccacggcgacgtggcgggcacggcgatggacagcactgcattgctgggtggcaccggcccgtcctggcgcgaggatggcttcaaccgcctgcgcgtgttcggcacgctgatgccgcgcggaggtgatctggtcacccatggctacgtcaacatcatgcccggcggcaaagtgctgttcgacgtgaccgagagcggcggcagtgccggtggtcgcgtgcgcgtgggtaatttcttcgacccgtccaccaacaaagtgctcgatggcgcgctggtgatctccaagggcgccttccttgaactgaacgtggcgcagggctattacagcaaggacttccgtcgcgatctggttgaaggcccgatctaccaggatggcttccaggaggtcgtgcggctgggcgacactggctaccgcgccagcatcagcggcggtgaggtgttccgtccgcgccacaactcgctgttgagtttcaatgtcaggcagacggccgacggtctgtggctgaccgccaacccgggcttcgaccagtgggatctgttcgccaacggcccgtccggtgatgacctggggcgtgtgctgggagctgcatccgatcgccaggacagtggcctgaagccgctgctgggcgccctgcagtttgccgaccgcgacgtggtcgcgcagcaggccggtgcgctgcgtggcgatgcgcacgccaccctgcgcctggccgacaacgccctgctgggcagcatcggcaacgtggtccagcagcatcaggcggcgatgcgcagtgccggtggcgatgccgatggcctggccgcgcaggtcgcgcagtcgatgtcggcacagccgggcatgcgccatggcaccctgttcaaccagctggcaatgcatctggtcgagccgacggcagcaggtgcgggggccagcggtgatggccagcgtggccacggtctgtgggcacgtggcttcgccagccatggccgcatcgatgccgatgccggcgtggccgggatgagccataccgtgggcggcatcgtggtcggtgccgatacgcgcctggccgatgaccgtgtcggcctgggcgtgagcgtggcggccgcggatatgtcgaccaaggcccgtggcgcctccagcttcaccggcgacgtgcgtgcgctggatgtgggcggttacctggacgcgatctacgcgcgcggttatctgtccgcggcggtgcgctacaccgacctgcgccacgacacccggcgcagcatcgccggcatcgagggcctgcaggacccgctgcgtgcgaagtacagcaacgatgcgatctccgcgcgggtggaacatgcgttctccttcaccagcggcaagggcgtggtgatccagccgctgctgccggtggtggactatgcgcgcacctccgcgacgcggttcaacgaagggcagggcgtggcggcgctggccgggcgtggcggcagcctggagagcatccgggtcggtgcgggcctgcagctgttcaagaccttcgagggcaacaacggcgagcgcatcaccccgcgggcgcgggtggtgtggcagaaggagctgggggatacgcaggcccgttacagcaccggctttgcggcggcgccggatctggtgttcggcagcaacagccagacggtgggcgagcaggtgctgagctggaacctgggtgtgaccagccgggccagcgagcggctgtcggtgatggtcgactatgtgggcgagcgccgcgacggccagctgcagaatggcgtgcagctggggctgggttaccggttctga

SEQ ID NO: 225 - DNA, 2052 bp, Streptomyces Sp.
atgactcgtacccggctgaccgcgctcgccgcgacggccgccctcgccgccaccggcgacctgatgatcgccgccccggcctccgcggccgtcacctgcgcctctcccgtctggaaagcgcagtacttcggcaactccaccttcagcggcacgccgaaactgaccgcctgcgactccgccgtcaacgagaactacgggtacggcgacccggccggcgtcacgctgcccaaggacaacttctccgtccgctggtccctcacccgggacttcggctccggcggcccgttccggctctccgccgccacccaggacggcatgcgtgtctacgtcgacggcgtacagaagatcaacctgtggaagaacgtctccaccaccgcccgcaagaccgtcgacctgaccgtcccggccggcaagcacacgctgcgcgttgactacgtcgcctggaccggtctcgcccacgccacgttcacgtacgccccgcgcacggaggccaccgtcgacacggtcaggccgctcgccccgaccggtctgaccgccgcgtacaaccgggacaccgcgaagaccaccctgcgctgggccgcgaacaaggagatggatctcgccggataccgcgtctaccgccggctgggcaccgcccagtgggtgagggccggcggctcgtcgctgctcgcctccccgtccttcgtggacgcgacgcccgccacgggccagaccttcctgtacgaggtccgcgccgtcgacaaggcgggccgcgagtccgtcggcagcctcgacgccaccgcggtgaccgtggaccgcacgggcccggcggcgccgaccggtctcacggtcaccggcgacgcgtggtgggcgaccctcgcctggcagggggccgcggacgccgcgacgtacgaggtgtacgccgcctccgcggccaccggcccgttcgagccgctgggcacgacgaccacgacgtcgtaccgcaccgacgctcccgtgaacaccgcccgcttctaccgggtccgcgctctcgacgcgctcggcaacccgtcggcgtacgccgccgtcaccggcgacggcgtcgaccgtacgccgccgaagtccccgacctccctcggctccgtcgtccgcgtcggctacaccgacgtgtactggaagcagcccgacggcttctacgaggacttcgacaacggcggggcctaccgcgtctaccgctcgcccggcaaggccctcgacccggccgcgctcacccgcgtgacctgcgccgaggagagcgacgagaccagcaccggtggcctctgccacgacctggacatgcccgcgggcacgtacgtgacgtacgcggtcgcggcggtggacccggccggcaacgagtcggcgctgtccgccccgctcgtcgtccgcaccggcgaccgcgtcgcacccgggccggtcaccggcgtgacggccaccccgcgcgccgacggcgtcctcatgagctgggcggcctcgaccgaggacgacgtcgagcgctacgtggtctggaccggcgtccggcaggccgacggcacggtcaagtggctcagctccacctcctgccgggagggcacgagcgacccgctcgcggtcctctgcggcgacctgccggacggcgagacgtacgtgtacgcggtcgtcgccagggacctctggggcaacgcgctgcccccgagcgacccgaaggtcacggtcgtccaggccaccgagctggatgtccggccgtccctgacggtcacccgggactgggacctcggcagcctgggccacggcaccgtgatcggcggacccgacgaggacgggccgtccatcagctggcggtgcgacaacacggccgagtgcgacagcgtcgcgggctaccgggtcagcaggtggaacgcggccgcgcaggcgtacgaaccgctgcacgccggactcctgccggcgcagacccgctcctacacggacacggctgccgcccggggtaccacgcacttctacacgctggaagcggtgcgcgccgacggcggtgtcgcgggcacgtacgtgtggaactgcgtcttccaggaccgcgtctag

SEQ ID NO: 226 - DNA, 2058 bp, Streptomyces Sp.
atgactcgtatccggttgacggtgctggccgcgacggccaccctcgccaccaccggcggcctgatcaccgccgcccctgcttccgcggccgtcacctgcgcctcttccgtctggagggcgcagtacttcggcaactccaccttcagcggcacgccgaagctgaccgcctgcgactccgtcatcgccgaggactacgggtacggcgacccgcccggcgtcacgctgcccaaggacaacttctccgtccgttggtccctcacccgggacttcggttccggcggccccttccggctcgccgccgcgacgcaggacggcatgcgcgtctacgtcgacggtgtgcggaagatcaacctgtggaagaacgtctccaccaccgcccgtaagaccgtcgacctgaccatcccggccggcaagcacacgctccgcgtggactacgtcgcctggaccggccgggccaacgccgggttcacatacgccccgcgtaccgaggccgccgtcgacacggtcaagccgctcgccccgaccggcctcaccgccgcgtacgaccgggacaccacgaagaccaccctgcgctgggccgcgaacaaggagatggacctcgccggttaccgcgtgtaccgccggctgagcaccacccagtgggcgaaggtcagcggatcgtcgctgctcaccgcctcctctttcgtggacgcgacgcccgccacgggccagaccttcctgtacgaggtccgcgccgtcgacaaggcgggccgcgagtccgccggcagccccgacgccaccgccgtgaccgtggaccgcacggggccggcgacgccgacgggtctcacggtcgtcggcgacgcctggtgggccaacctggcctggcagggggtcgccgacgccgcgacgtacgaggtgcacgccgctcccgcggcctccggtccgttcgagccgctgggtacgacgaccacgacgtcgtaccgcaccaccgcacccgagaacaccgtccgccactaccgggtccgcgccctcgacgcgctcggcaacccgtcggcgtacgccgacgtcaccggcgacggcgtcgaccgcacgccgccgaagtccgccccgacctccctcgactccatcgccgaagtcggctacaccgacgtgtactggaagcagcccgacggcttctacgaggacttcgacaacggcgggacctaccgcgtctaccgctcgcccggcaagaccctcgacccggccgcgctcacccgcgtgacctgcgccgaggagagcagcgacgagaccagcaccggcggcgtctgccacgacctggacatgcccgcgggcacgtacgtgacgtacgcggtcgcggcggtggacccggccggcaacgagtcggcgctgtccgccccgctcgtcgtccgcaccggcgaccgggtcgcgcccggcccggtcacgggcgtgaaggccaccccgcgcgccgacggcgtgctgatgagctgggcggcctcgaccgaggacgacgtcgagcgttacgcggcctggaccggcgcccggcaggccgacggcacggtcaagtggctcggctccagctcctgccgggagggcacgagcgacccgctcgcggtcctctgcggcgatctgccggacggcgagacgtacgtgtacgcggtcgtcgcgagggaccgctggggcaacgcgctgccccccagcgacccgaaggtcacggtcgtcgaggccaccgagctggacgtccggccgtccgtgacggtcacccgggactgggatctcggcagcatgggctacggcaccgtgatcggcggacccgacgaggacgggccgtccatcaactggcggtgcgacaggacggctgactgcgacaccgtcgcgggctaccgggtcggacggtggaatgcggccacgaaggcgtacgagccgctgcacgccggactgctgccggcggagacccgtgcctacacggacaccacggcggcgcgggggaccacgcacttctacacgctggaggcggtgcgcgccgacggcagcgtcgcgggcacccacgtgtggggctgcgtcttccaggaccgcgtctag

SEQ ID NO: 227 - DNA, 2058 bp, Streptomyces Sp.
atgactcgtatccggttgacggtgctggccgcgacggccaccctcgccaccaccggcggcctgatcaccgccgcccctgcttccgcggccgtcacctgcgcctcttccgtctggagggcgcagtacttcggcaactccaccttcagcggcacgccgaagctgaccgcctgcgactccgccatcgccgaggactacgggtacggcgacccgcccggcgtcacgctgcccaaggacaacttctccgtccggtggtccctcacccgggacttcggttccggcggccccttccggctcgccgccgcgacgcaggacggcatgcgcgtctacgtcgacggtgtgcggaagatcaacctgtggaagaacgtctccaccaccgcccgcaagaccgtcgacctgaccatcccggccggcaagcacacgctccgcgtggactacgtcgcctggaccggccgggccaacgccgggttcacgtacgccccgcgtaccgaggccgccgtcgacacggtcaagccgctcgccccgaccggcctcaccgccgcgtacgaccgggacaccacgaagaccaccctgcgctgggccgcgaacaaggagatggacctcgccggttaccgcgtgtaccgccggctgagcaccacccagtgggcgaaggtcagcggatcgtcgctgctcacctcttcctctttcgtggacgcgacgcccgccacgggccagaccttcctgtacgaggtccgcgccgtcgacaaggcgggccgcgagtccgccggcagcgccgacgccaccgccgtgaccgtggaccgcacggggccggcgacgccgacgggtctcacggtcgtcggcgacgcctggtgggccaacctggcctggcagggggtcgccgacgccgcgacgtacgaggtgtacgccgctcccgcggcctccggtccgttcgagctgctgggtacgacgaccacgacgtcgtaccgcaccaccgcacccgagaacaccgtccgccactaccgggtccgcgccctcgacgcgctcggcaacccgtcggcgtacgccgacgtcaccggcgacggcgtcgaccgcacgccgccgaagtccgccccgacctccctcgactccatcgccgaagtcggctacaccgacgtgtactggaagcagcccgacggcttctacgaggacttcgacaacggcgggacctaccgcgtctaccgctcgcccggcaagaccctcgacccggccgcgctcacccgcgtgacctgcgccgaggagagcagcgacgagaccagcaccggcggcgtctgccacgacctggacatgcccgcgggcacgtacgtgacgtacgcggtcgcggcggtggacccggccggcaacgagtcggcgctgtccgccccgctcgtcgtccgcaccggcgaccgcgtcgcgcccggcccggtcacaggcgtgaaggccaccccgcgcgccgacggcgtgctgatgagctgggcggcatcgaccgaggacgacgtcgagcgttacgcggcctggaccggcgcccggcaggccgacggcacggtcaagtggctcggctccagctcctgccgggagggcacgagcgacccgctcgcggtcctctgcggcgacctgccggacggcgagacgtacgtgtacgcggtcgtcgcgagggaccgctggggcaacgcgctgccccccagccatccgaaggtcacggtcgtcgatgccaccgagctggacgtccggccgtccgtgacggtcacccgggactgggatctcggcagcatgggctacggcaccgtgatcggcggacccgacgaggacgggccgtccatcaactggcggtgcgacaggacggctgactgcgacaccgtcgtgggctaccgggtcggacggtggaatgcggccacgaaggcgtacgagccgctgcacgccggactgctgccggcggagacccgtgcctacacggacaccacggcggcgcgggggaccacgcacttctacacgctggaggcggtgcgcgccgacggcagcgtcgcgggcacccacgtctggggctgcgtcttccaggaccgcgtctag

SEQ ID NO: 228 - DNA, 2043 bp, Streptomyces Sp.
atgactcgtacccggctgtccgcgctggccgcgacggcggcgctcgccaccaccggcggcctgatcaccgccgcccccgcctccgcagcggtcacctgcacctctcccgtctggagggcgcagtacttcggcaactccaccttcagcggcacgccgaagctcaccgcctgcgacaccgccatcagcgagaactacgggtacggcgatccggccggcgtcacgctgcccaaggacaacttctccgtccgctggtccctcactcgggacttcggctccggcggccccttccggctctccgccgccacgcaggacggcatgcgcgtctacgtcgacggtgtgcggaagatcgacctgtggaagaacgtctccacaaccgcccgcaagaccgtcgacctgaccatcccggccggcaagcacacgctccgcgtggactacgtcgcatggaccggcgccgccaacgccgccttcacgtacacccctcgcaccgaggccgccgtcgacacggtcaagccgctcgccccgaccggcctcaccgccgcgtacgacaggacgaccgccaagaccaccctgcgctggaccgccaacaaggagatggacctcgccgggtaccgcgtgtaccgccgactgagcgccaccagctgggccaaggtcagcgggacgtccctgctgaccacccggtccttcgtcgacgccccgcccgccaccggccagaccttcctgtacgaggtccgcgccgtcgacaaggccggccgcgagtccaccggcagcccggacgtgacggcgacgaccgtcgaccgcaccgggccggcagcccccaccggactcacggtcgccaccggcgacgggtggtgggacaccctgaactggcagggagtcgccgacacggcgaagtacgaggtgtacgcctcgtccgcggctgccggaccgttcgagctgcgcggtacgacgaccacgacgtcgtaccggaccagcggcgccgtgaacacgaacacgtactaccgggtccgggccctggacgcagccggcaacccgggggcgtacgcgacggtcaccagcgacggcgtcgaccggatgccaccgaagtccccgaccggcgtcaccgccggcgcccgtcccggctacaccaatgtccactggagccagcccgacggtttctacgaggactgggacaacggcgggcactaccgcgtgtaccgctcgcccggcaagacgttcgacccgaccgcgcgcacccaggtgacctgcgtcgcggaggagagccacgaggcgagcaacggcggcaactgctacgacgtggacatgcccgcgaacacgtacgtgacgtacgccgtcacggcggtggacccgtacggcaacgagtcggcgtactccgcgccggtcgtcgtccgcaccggcgacaccgtggcgcccggcccggtcaccggcgtgaaggtcaccccgcgcaacgacggcatgctggtgagctgggccgcctcgcccgaggacgacatcgacgagtacgtggtctggacgggcgtccggcaggccgacggcacggtcaagtggctccgccccgccacctgcgcggagggcacgagcaactggctcgcgatcctctgcggcaacctgccggacggcgaggcgcacgtgtacgcggtgacggccaaggaccactggggcaacacgctgcacccgagcgacccgaaggtcaccgtggtcgaggccaccgagctcgacgtccggccgtccgtgaccgtcacccgggactggagcctcggcagcctgggccacaaccggacgaccactcgtccgtccgtcgactggcagtgcaccgacacgacccgctgcgccacggtcaccggctaccgcgtgagccgatggaacccggtgaccaaggcgtacgagccccagcacgacggactgctcccggcggacgcccggacctgggaggacgccacggcgacgaaggggaacacatacttctacacgctggaggccgtgacggccgacggcgccgtggtggggacgtacccctggtacaccgtcttccaggaccgcgtctag

SEQ ID NO: 229 - DNA, 2043 bp, Streptomyces Sp.
atgactcgtacccggctgtccgcgctggccgcgacggcggcgctcgccgccaccggcggcctgatcaccgccgcccccgcctccgcagcggtcacctgcacctctcccgtctggagggcgcagtacttcggcaactccaccttcagcggcacgccgaagctcaccgcctgcgacaccgccatcagcgagaactacgggtacggcgacccggccggcgtaacgctgcccaaggacaacttctccgtccgctggtccctcacccgggacttcggctccggcggccccttccggctctccgccgccacgcaggacggcatgcgcgtctacgtcgacggtgtgcggaagatcgacctgtggaagaacgtctccacaaccgcccgcaagaccgtcgacctgaccatcccggccggcaagcacacgctccgcgtggactacgtcgcatggaccggcgtcgccaacgccgccttcacgtacaccccgcgcaccgaggccgccgtcgacacggtcaagccgctcgccccgaccggactcaccgccgcgtacgactggacgacggccaagaccaccctgcgctggaccgccaacaaggagatggacctcgccgggtaccgcgtgtaccgccggctgagcgccaccagttgggtcaaggtcagcgggacgtccctgctgaccacccggtccttcgtcgacgccccgcccgccaccggccagaccttcctttacgaggtccgcgccgtcgacaaggccggccgcgagtccgccggcagcccggacgtgacggcgacgaccgtcgaccgcaccgggccggcagcccccaccggactcacggtcgccaccggcgacgggtggtgggacaccctgaagtggcagggagtcgccgacacggcgaagtacgaggtgtacgcctcgtccgcggctgccggaccgttcgagctgcgcggtacgacgaccacgccgtcgtaccggaccagcggcgccgtgaacacgaacacgtactaccgggtccgggccctcgacgcagccggcaacccgggggcgtacgcgacggtcaccagcgacggcgtcgaccggatgccaccgaagtccccgaccggcgtcaccgccggcgcccgtcccggctacaccaacgtgcactggagccagcccgacggtttctacgaggactgggacaacggcgggcattaccgcgtgtaccgctcgcccggcaagacgttcgacccgaccgcgcgcacccaggtgacctgcgtcgcggaggagagccacgaggcgggcaacggcggcaactgccacgacgtggacatgcccgcgaacacgtacgtgacgtacgccgtcacggcggtggacccgtacggcaacgagtcggcgtactccgcgccggtcgtcgtccgcaccggcgacaccgtggcgcccggcccggtcaccggcgtgaaggtcaccccgcgcaacgacggcatgctggtgagctgggccgcctcgcccgaggacgacatcgacgagtacgtggtctggacgggcgtccggcaggccgacggcacggtcaagtggctcggccccgccacctgcgcggagggcacgagcaactggctcgcgatcctctgcggcgacctgccggacggcgaggcgcacgtgtacgcggtgacggccaaggaccactggggcaacacgctgcacccgagcgacccgaaggtcaccgtggtcgaggccaccgagctcgacgtccggccgtccgtgaccgtcacccgggactggagcctcggcagcctgggccacaaccggacgaccactcgtccgtccgtcgactggcagtgcaccgacacgacccgctgcgccacggtcaccggctaccgcgtgagccgatggaacccggtgaccaaggcgtacgagccccagcacgacggactgctcccggcggacgcccggacgtgggaggacgccacggcgacgaaggggaacacatacttctacacgcttcaggccgtgacggccgacggcgccgtggtggggacgtacccctggtacaccgtcttccaggaccgcgtctag

SEQ ID NO: 230 - DNA, 2043 bp, Streptomyces Sp.
atgactcgtacccggctgtccgcgctggccgcgacggccgcgctcgccaccaccggcggcctgatcaccgccgcccccgcctccgcggcggtcacctgcacctctcccgtctggagggcgcagtacttcggcaactccaccttcagcggcacgccgaagctcaccgcctgcgacaccgccatcagcgagaactacgggtacggcgacccggccggcgtcacgctccccaaggacaacttctccgtccgttggtccctcacccgtgacttcggctccggcggcccattccggctctccgccgccacgcaggacggcatgcgcgtctacgtcgacggtgtgcggaagatcgacctgtggaagaacgtctccaccaccgcccgcaagaccgtcgacctgaccatcccggccgggaagcacacgatccgcgtggactacgtcgcatggaccggcgtcgccaacgccgccctcacgtacaccccgcgcaccgaggccgccgtcgacacggtcaagccgctcgccccgaccggcctcaccgccgcgtacgactggacgacggccaagaccaccctgcgctggaccgccaacaaggagatggacctcgccgggtaccgcgtgtaccgccggctgagcgccgccaactgggccaaggtcagcgggacgtccctgctgaccacccggtccttcgtcgacgccccgcccgccaccggccagaccttcctgtacgaggtccgcgccgtcgacaaggccggccgcgagtccaccggcagcccggacgtgacggcggcgaccgtcgaccgcaccgggccggccgcccccaccggactcacggtcgccaccggcgacgggtggtgggacaccctgaactggcagggagtcgccgacacggcgaagtacgaggtgtacgcctcgtccgcggctgccggaccgttcgagctgcgcggcacgacgaccacgacgtcgtaccggaccagcggcgccgtgaacacgaacacgtactaccgggtccggcccctcgacgcagccggcaacccgggggcgtacgcgacggtcaccagcgacggcgtcgaccggatgccaccgaagtccccgaccggcgtcaccgccggcgcccgtcccggctacaccaacgtgcactggagccagcccgacggtttcttcgaggactgggacaacggcgggcactaccgcgtgtaccgctcgcccggcaagacgttcgacccgaccgcgcgcacccaggtgacctgcgtcgcggaggagagcgacgaggcgagcaacggcggcaactgctacgacgtggacatgcccgcgaacacgtacgtgacgtacgccgtcacggcggtggacccgtacggcaacgagtcggcgtactccgcgccggtcgtcgtccgcaccggcgacaccgtggcgcccggtccggtcaccggcgtgaaggtcaccccgcgcaacgacggcatgctggtgagctgggccgcctcgcccgaggacgacatcgacgagtacgtggtgtggaagggcgtccggcaggccgacggcacggtcaagtggctcggccccgacacctgctcggaaggcacgagcaactggctcgcgatcctctgcggcaacctgccggacggcgagacgcacgtgtacgcggtgatggccaaggaccactggggcaacacgctgcacccgagcgacccgaaggtcaccgtggtcgaggccaccgagctcgacgtccggccgtccgtgaccgtcacccgggactggagcctcggcagtctgggccacaaccggacggccactcgtccgtccgtcgattggcagtgcaccgacacggcccgctgcgccacggtcaccggctaccgcgtgagccggtggaacccggcgaccaaggcgtacgagccccagcacgacgggctgctccaggcggacgcccggacgtgggaggacgcgacggcgacgaaggggaacacgtacttctacaccctggaggccgtgacggccgacggcgccgtggtggggacgtacccctggcacaccgtcttccaggaccgcgtctga

SEQ ID NO: 231 - DNA, 2046 bp, Streptomyces Sp.
atgactcgtacccggctgtccgcgttggccgcgacggccgcgctcgccaccaccggtggcctggtgaccgccgccgcccccgcctccgcggcggtcacctgcacctctcctgcctggaaggcgcagtacttcggcaactccaccttcagcggcacgccgaaactcaccgcctgtgacaccgccatcagcgagagctacgggaagggcgacccggccggcgtcacgctgcccaaggacaacttctccgtccgttggtccctcaaccgtgacttcggctcgggcggacccttccggctctccgccgctacgcaggacggcatgcgcgtctacgtcgacggtgtgcggaagatcaacttgtggaagaacgtctccgccaccgtccgcaagaccgtcgacctgaccatcccggcaggcaagcacacgatccgcgtggacttcgtggcctggaccggcgtcgccaacgccgccttcacctacaccccgcgcaccgaggccgccgtcgacacggtcaagccgctcgccccgaccgggctcaccgccgcgtacgaccggacgacggccaggaccaccctgcgctgggccgccaacaaggagatggacctcgccgcgtaccgcgtgtaccgccggctgagcaccaccagttgggccaaggtcagcgggacgtccgcgctgaccacccggtccttcgtcgacgccccgcccgccaccggtcagacctttctgtacgaggtccgcgccgtcgacaaggcgggccgcgagtccaccggtagcccggacgtgacagcgacgaccgtcgaccgcaccgggccggccgcccccaccgggcttgtggtcaccaccggcgacgggtggcacgacaccctgaactggcagaaggccgccgacgcggcgaagtacgaggtgtacgcctcgcccgcgcccaccggaccgttcgagctgcgcggcacgaccaccacgacgtcgtaccggacgaacggcgccgtgaacaagaacacgtactaccgggtccgggcccttgatgcggtcggcaacccgggtgcgtacgcggcggtcaccagcgacggcgtcgatcggatgccaccgaagtccccgaccgacctcaacgtcgtcgcccgtcccggctacaccgacctgcactggcaccagcccgacagtttcaccgaggactacgacaacggcgggtactaccgcgtgtaccgctcgcccggcaagacgttcgacccggcagcgcgaacccaggtgacctgcgccgcggaggagagcgacgacgccggcaacggcggcaactgctacgacgtggacatgcccacgaacacgtatgtgacgtacgccgtcacggcggtggacccgtacggcaacgagtcggcgtactccgccccgctcgtcgtccgcaccggcgacaccgtggcacccggcccggtcaccggagtgaaggtcaccccgcgcaacgacggcatgctggtgagctgggccgcctcgcccgaggacgacatcgacgagtacgtggtgtggaagggcgcccggcaggccgacggcacggtcacgtggctcggtcccgacacctgctcggagggcacgagcaactggctcgcgatcctctgcggcaacctgccggacggccagacgcacgtgtacgcggtggtggccaaggaccactggggcaacacgctgcacccgagcgacccgaaggtcaccgtggtcgcggccaccgaacgcgacgtccggccgtccgtgaccgtcacccgggactggagcctcggcagcctgggacacaaccggacggccactcgtccgtccatcgactggcagtgcaccgacacggcccgctgcgccacggtcacgggcttccgcgtgagccggtggaacccgacggccaaggcatacgagccccagcacgacggactgctcccggcgggcgcccgtacgtgggaggacgccacggcgacgaagggggacacgtacttctacacgcttgaggccgtgacggccgatggcaccgtggtggggacgtacccgtggtacatcgtcttccaggaccgcgtctga

SEQ ID NO: 232 - DNA, 1980 bp, Streptomyces Sp.
atgactgccgcccccgccactgcggcggtcacctgcatctctcccgtctggaaggcgcagtacttcggcaactccaccttcagcggcacgccgaagcgcaccgcctgcgacaccgccatcagcgaaagctacgggcgcggcgacccggccggcgtcacgctacccaaggacaacttctccgtccgttggtccctcgaacgtgacttcggctcgggcggacccttccggctctccgccgccacgcaggacggcatgcgcgtctacgtcgacggtgtgcggaagatcgacctgtggaagaacgtctccaccaccgcccgcaagaccgtcgacctgaccatcccggcaggcaagcacacgatccgcgtggactacgtcgcctggaccggcgtcgccaacgccgccttcacgtacaccccgcgcaccgaggccgccgtcgacacggtcaagccgctcgccccgaccggcctcaccgccgcgtacgacggggcgacgaccaggaccaccctgcgctggagcgcgaacaaggagatggacctcgcggggtaccgcgtgtaccgccgactgagcaccaccagctgggccaaggtcagcgggacgcccctgctgaccacccggtccttcgccgacgccccgcccgccaccggccagacctttctgtacgaggtccgcgccgtcgacaaggcaggccgcgaatccaccggcagcccggacgtgacggcgacgaccatcgaccgcaccgggccggccgcccccaccggactcgtggtcaccaccggcgacgggtggtacgacaccctgaactggcagaaggccgccgacacggcgaagtacgaggtgtacgcctcgctcgtgcccaccggaccgttcgagctgcgcggtacgacgaccgcgacgtcgtaccggaccgatggcaccgtgaacaagaacacgtactaccgggtccgggccctcgatgcggccggcaacccaggggcgtacgcgtcggtcaccagcgacggcgtcgaccggatgtcaccgcagtccccgaccggtctcaacgtcgtcgcccgccccggctacaccgacctgtactggcaccagcccgacagcttctccgaggactacgacaacggcgggtactaccgcgtgtaccgctcgcccggcaagacgttcgacccggcagcgcgcacccaggtaacctgcgtcgcggaacagagcgacgacgccgccaacggcggcaactgctacgacatgggcatgcccgcgaacacgtacgtgacgtacgccgtcacggcggtggacccgtacggcaacgagtcggcgtactccgccccgctcgtcgtccgcaccggcgacaccgtggcgcccggcccggtcaccggcgtaaaggtcaccccgcgcaacgacggcacgctggtggactgggccgcctcacccgaggacgacatcgacgagtacgtggtgtggaagggcgtccggcaggccgacggcacggtcaagtggctcggccccgacacctgctcggagggtacgagcaactggctcgcgatcctctgcggcaacctgccggacggtgagacgcacgtgtacgcggtggtggccaaggaccactggggcaacacgctgcacccgcgcgacccgaaggtcaccgtggccgaggtcaccgaactcgacgtccggccctccgtgaccgtcacccgggactggagcctcggcactctgggccacaaccgtacggccactcgtccgtccgtcgactggcagtgcaccgacaccacccgctgcgccgcggtctccggttaccgtgtgagccggtggaacccggcggccaagacatacgagccccagcacgacggactgctcccagcgggctcccggacgtggcaggacgccacggcgacgaaggggaacacgtacttctacacgctggaggccgtgacggccgacggcaccgtcgtggggacatacccgtggtacaccgtcttccaggaccgcgtctga

SEQ ID NO: 233 - DNA, 2067 bp, Streptomyces Sp.
ttggtccagaaggggccctctctcctgatgactcgtacccagctgtccgcgctggccgcgaccgcggcgctcgccaccaccggcggcctgatcaacgccgcccccgcctccgcggcggtcacctgcgcctctcccgtctggaaggcgcagtacttcggcaactccaccttcagcggcacgccgaagctgaccgtctgcgactccgccatcagcgagaactacggttacggcgacccggccggcgtcacgctgcccaaggacaacttctccgtccgctggtccctgacccgtgacttcggctccggcggccccttccggctctccgccgccacgcaggacggcatgcgcgtccacgtcgacggcgtgcggaagatcgacctgtggaagaacgtctccaccaccgcccgtaagaccgtcgacctgaccctcccggccggcaagcacacgatccgcgtggactacgttgcctggaccggcgtcgccaacgccgccttcacctacaccccgcgcaccgaggccgccgtcgacacggtcagaccgctggccccgaccggcctcaccgccgcctacggtcgcgacaccgccaggacgaccctgcgctgggccgccaacaaggagatggacctcgccgggtaccgcgtgtaccgccggctgagcgccacgagctgggcgaaggtcagcggcacgtcgctgctcaccaccccgtccttcgtcgacgcctcgcccgcgaccggccagaccttcctgtacgaggtccgcgccgtcgacaaggccggccgcgagtccaccggcagcccggacgtgacggcgacgaccgtggaccgcacgggcccggtggccccgaccggtctcacggtcgtcagcgacgcgtggtgggccgccctgagctggcaggcggtcaccgacgcggcgaagtacgaggtgtacgcctcgcccgaggccgtcggcccgttcacgctgctgggcacgacgaccacggcgtcgtaccggaccgacgcgcccccgaacgccctgcgctactaccgcgtccgcggcgtcgacgcgctcggcaacccgggggcgtacgccacggtcaccggcgacggcgtcgaccgtacgccgccggaggccccgaccggcctgaactcctacgccgttcccgcctccacctcggtgaactggacggcgcccggcggccgctgggtcgaggactgggacaacggcgggcactaccgcgtgtaccgctcgcccggcaagaccttcgacccggccgcgcgcaccgcggtggcctgcgccgaggggagcgacgaggcgggcaacgggggccggtgcgtcgacctgggcatgcccgtgaacacgtacgtgacgtacgccgtcacggcggtggacccggacggcaacgagtcggcgtactccgcgccgctcgtcgtccgcaccggcgacaccgtggcgcccggcccggtctcgggcgtgaaggtcaccccgcgcgccgacggcatgctggtgagctgggccgcctcgcccgaggatgacatcgacgagtacgtggtgtgggcgggcgtccggcaggccgacggcacggtcaagtggctcggccccgacacctgcgcggagggcacgagcaacccgctcgcgatcctgtgcggcggcctgccggacggcgagacgcgcgtgtacgcggtgatggccaaggaccgctggggcaacacgctgcacccgagcgacccgaaggtcaccgtggtcgaggccaccgagctcgacgtccggccgtccgtgaccgtcacccgggactggaacctcggcaggctgagccacaacgcgacggccacccgtccgtccgtcgactggcagtgcaccgacacggcccgctgcgccacggtgaccggctaccgggtgagccggtggaacccggtgaccgaggcgtacgagacccagcacgacggactgctcccggcggacgcccggacgtgggcggacaccacggcgacgaaggggaacacgtacttctacacgctggaggccgtgacggccgacggcgccgtggtgggcacctacccctggtacaccatcttccaggaccgcgtctag

SEQ ID NO: 234 - DNA, 1851 bp, Streptomyces Sp.
atgggctccggcgacccggccggcgtcacgctgccgaacgacaacttctccatccgctggtccgtcactcgggacttcggttccggcggcccgttccggctgtccgcggccacccaggacggcatgcgcgtctacgtcgacggcgtgcgcaagatcgacctgtggcagaacgtctccaccaccgtgcgcaaggccgtggacctcaccatcccggccggccgccacacgatccgcgtggactacgtcgcctggaccggttatgcctacgccgggttcacctacctcccgcgcaccgaggcgagcgtcgacacggtcaagccgctggccccgactggtctgaccgccgcgtacagccgagacaccgcgaagaccacgctgcgctggtcgtccaacaaggagatggacctcgccgggtaccgcgtctaccggcggctgagcaacaccccgtgggcgcaggtcagcggcagctcgctgctcaccaccccctccttcgtcgacgcgccgcccgcgaccggccagaccttcctttacgaggtccgcgccgtggacaaggctggccgtgagtccaccggcagcctggacgtcaccgccgcgacggtggaccgcacgggcccggcggccccgaccggtttcacggtcgtcagcgacgcgtggctggccacactgaactggcaggccgtcgccgacgcggcgaagtacgaggtgtatgcctcgtccgcggctaccggcccgttcgagctgctcaccacgacgactacgacgtcgtaccgcaccagcgcgcccacgaacgcgaaccagtactaccgcgtccgcggcatcgacgcgtccggcaacccgggggcgtacgccaccgtcgccggcgacggcgtcgaccgcacaccgccggggtccccgaccggcctgaactccgtcgcccgtcccggctccaccgcggtgtactggacggcgcccggcggccgctgggtcgaggactgggacaacggcgggcactaccgcgtctaccgctcgcccggcaagaccttcgacccggccgcccgtaccgaggtggcctgcgccgaagaggggagcaacgaggcgggcaacgggggcgcgtgcgtcgacctggacatgcccgagaacacgtacgtgacgtacgccgtcacggcggtggacccggacgacaacgagtcggcgtactccgccccgctcgtcgtccgcaccggtgacacggtggcgccgggcccggtcaccagcgtgaaggtcaccccgcgtagcgacggaatgctggtgagctgggccgcctcgcccgaggacgacatcgacgagtacgtggtgtgggccggcgccaggcaggccgacggcgcggttaagtggctcggccccgaccgctgctgggagggtgtgagcaacccgctcgcgatcgtctgcggcaacttgccggacggcgagacacgcgtgtacgcggtgatcgcgaaggaccactggggcaacgggctgcacccgagcgaccctaagatcaccgccgtcgaggccaccgagctcgacgtccggccctccgtgacggtcacccgggactggaacctcggcagcctcagccacaacccggcggccacccgcccgtccgtcgactggcagtgcaccgacacgacccagtgcggcgccgtcaccggctaccgcgtgaatcggtggaaccccgcgaccaaggcgtacgacccccagcacgacggactgctcccggccgacgcccgaacgtggacggacctcacggcaacgaaagggaacacgtacttctacacactggaggccgtgacggccgacggcgccgtggtggggacgtacccctggtacacgatcttccaggaccgcgtctaa

SEQ ID NO: 235 - DNA, 2268 bp, Streptomyces Sp.
atgcgaatacctctcggcacgacccgccgtacaggtggtgcggcagcgctctccttggcaacagcgctcgccgggctcgccttccccacgaccgcgcatgcggccgtgacctgttcggccggcgtgtggaaggcccagtactacgccaacaccaccctctccggcactccgaaggccaccgtctgcgacagcgccgtcgccgagaactacggctccggtgacccctccggtgtgacccttccgaacgacaacttcggcgtccgctggaccaccacccgcaacttcggctccggtggccccttcaacctgagcctcgccgtccaggacggcgcccgcgtctacctcgacggctcccgcaagatcgacctgtggcgaaacgtcacttcgacccagcggaagaccgtacgcctcaccatcccgcgcggaacccacactctgcgcgtcgacttcgcagccttcaccggcaccgccaacgtcgccttctcctacgcgccggtcatcggagccacgtacgacaagaccgtccccctggccccggtcggagtgaagtccggtttctcggcgtccacactgaagacgaccctgacctggtcccgcaactacgagatggacctggccggttaccgcgtctaccgccgcgtcgccggcaccagcagctggagcctgcgcaactccactctgatcacgggctccaccttcaccgaagcgcccccggcgaccggcgccgcctacgagtacgccctccgcgccgtcgaccgctccggcaacgtctccccgctctccgcggtgacgagcgtcgtcagcgccgacaggacggcccccgccgtgcccaccgggctcacggctacgtacgacccgtccgccggcgcccggctcgcctggtccccggtgagcggggcgagctcctacgaggtgcagcgggccgtcgcgcccgaggggccgttcgccccggtcggcacgccccttcagggcgccgtcctgaccgacccggccgccgccgcgggcacgacctacttctaccgcgtgcgggccaaggacggcgcgggcaacgcttccgcgtactccacgtccgtccggctcgacgccgccgaggccaagccactgccgccgacggccgtctccgccaccggactgcccgaccgcaacaccgtcggctggcagtacgacggtgacgcgtcccaccggttccacgtctccggcgccgactcggccgccggcccgtggacccggttgaccgacacgccggtcaccggcaccagctacgacgactacgcggcgcccgtcggcgaggcgcgctactaccaggtcagcacggtcacgacactcggcacggagtcggacccgtccacgaccgcctcggccacccgcatccgcgacgtcaccccgccgcacatgccgtacggcctggacgcctgggacgccacggacggtgtgcacctcgtctggacgcccaacaccgacgacacggaccactatctggtcatgcgcaagtcgatgttcggcgcgtgggagcagatcgccgtggtgcgggacggcaagtacctggacaccggcaccgcgcccgacgtccagttcggttacaccgtccgcgccgtcgacggcgccggcaacgtctccccgctgcccgagcccggctacggcaccgtctacggcaaacgcctgccggtctacgagaagccggccgcgcccgcctcggtgaccgcgacggccgacaacggcaacgtcaaggtggagtggaccccgagcacgtcgaccgacgtggccggctactacgtctaccgcacgaccgtcgcggacccgacgacggcctactcggtctccccgttcatcaccgggacgacgttcacgaacgtggacgtgcccgccggcaattcctggtactacgtggtgcgcgtcgtcagcacccacagccagtggtccgactactcgccgatggcccaggtcaccgtgccctgcccggtcctgaccggaccgccgaccccccggatcaccggaggcggcaggggcgcggactacgcccagctcaactggcaggtcggagcgtgcgaccagggtgcgaccgtctcgtacaacgtctaccggtccacgtccagcgcggacgtcttcacccctgagcaccgcatcgccacgggcgtgacggcactgacgtacaaggatcccggtctggcacgggcgtactactactacgtcgtcaccgccgtggcggccgacggcaccgaatcggccccgcaggccacgccgttcgggatatcgatgatggcgccctga

SEQ ID NO: 236 - DNA, 2268 bp, Streptomyces Sp.
atgcgaatatccctcggcgcggcccgccgtacaggtggtgcggccgtgctctccttggccacagtcctggccgggctcgctttccccacgaccgcgcacgcggccgtgaactgctcggccggcgtgtggaaggcccagtactacgccaacaccaccctctccggcactccgaaggccaccgtctgcgataccgccatcgccgagaactacggctccggcgacccctccggggtgagcctgccgagcgactacttcggcgtccgctggaccaccacccgcaacttcggctccggcggccccttcgacctgagcgtcgccgtccaggacggcgcccgcgtctacgtcgacggctaccgcaagatcgacctgtggcgcaacgtcagctcgacccagcggaagaccgtccgcttcaccatgccgcgcgggacccacaccctgcgtgtggacttcgccgccttcaccggcaccgccaacgtctccttctcctacaagccggtcatcggcgccacctacgacaagaccgcccccctggccccggtcggcgtgaagtccagctactcggcgtccaccctgaagacgaccctgacctggtcccgcaactacgagatggaccaggccggttaccgcgtctaccgccgcgtcgccggcagcagcggctggagcctgcgcaactccaccctgatcacgggcaccaccttcaccgacacgcccccggccaccggcgccgcctacgagtacgccctccgcgccgtcgaccgctccggcaacgtctccgcgctgtccgcggtgacgagcgtcgtcagcgccgacaggacggcccccgccgtgcccaccgggctcacggccacgtacgacccgtctgccggcgcccggctctcctggtccccggtgagcggggcgaactcctacgaggtgcagcgggccgtcgcgcccgaggggccgttcgcctcggccggcacgcccacgcagagcgccgccctgaccgacccgtccgccgccgtgggcacgacctactactaccgcgtgcgggccaaggacagcgcgggcaacgcctccgcgtactccgcgcccatccagctcgacgccaccgaggccaagccgctgccgcccacggccgtctccgccaacggctgggtcgaccgcaacagcgtcggctggcggtacgacggtgacgcgtcccaccggttccacgtctatgccgccgaggcggccgccggtccttggacccggctgaccgagacgccggtcaccggccccggctacgacgactacgcggcgcccgtcggcgaggtgcgccactaccaggtcaggacggtcacgactctcggcacggagtcgaacccgtcagcgacggcctcggccacccgcaccggcgacgtcaccccgccgcgcatgccgtacggcctggacgcctgggacgccacggacggcgtgcacctcgtctggatgcccaacaccgacgacacggaccactacctcgtcatgcgcatgcagacgttcggcgcgtgggagcaggtcgcagtggtgcgggacgccaagtatctggacaccagcaccccggccggcgtgcggttcggctacaccgtccgcgccgtcgacgcggccggcaatgtctcccccatgcccgagcccggctacggcaccgtctacggcaagcgcctgccggtccacgagaagccggccgcgcccgcctcggtcaccgcgacggccgacaacggcaacgtcaaggtggagtggaccgcgagcacgtcgaccgatgtggccggctaccacgtctaccgcacgaccggcacggacccgacgacggcctactcggtctccccgttcatcaccgggacgacgttcacgaacgagaacgtgcccgccggcaagacctggcgctacgtggtgcgcgccgtcagcacgcacaaccagtggtccgacttctcgccgatggccgaggtcaccgtgccctgcccggtcctgaccggaccggccaccccccggatcaccgggggcggcaggggcgcggactacgcccagctcaactgggaggtcggagcatgcgaccagggtgcgaccgtctcgtacaacgtctaccggtccacgtccagctcggacgtcttcacccctgagcaccgcatcgccacgggtgtgacggcgctgacgtacaaggaccccggtctggcgcgggcgtactactactacgtcgtcaccgccgtggccgccgacggcaccgagtcggccccgcaggccgtgccgttcgggatatcgatgatggcgccctga

SEQ ID NO: 237 - DNA, 2268 bp, Streptomyces Sp.
atgcgaatatccctcggcacggcgagccgtacaggcggtgcggccgtactctccttggccacagccctggccgggctcgccttccccgcgaccgcgcacgcggccgtgacctgcccggccggcgtgtggaaggcccagtactacgccaacaccaccctttccggcactccgaaggccaccgtctgtgacaccgcgatcgcggagaactacggctacggcgacccctccggcgtgaccctgccgagcgaccacttcggcatccgctggaccaccacccgcaacttcggctccggcggccccttcgacctgagcgccgccgtccaggacggcgtccgcgtctacgtcgacggccaccgcaagatcgacctgtggcgcaacgtcagctcgacgcagcggaagaccgtccgcttcaccatgccgcgcggcacccacaccctgcgtgtggacttcgccgccttcaccggcaccgccaacatctccttctcctacaagccggtcctcggcgccgcgtacgacaagaccgcccccctggcaccggtcggcgtgaagtccggctactcggcgtccaccctgaagtcgaccctgacctggtcccgcaaccacgagatggacctggccggctaccgcgtctaccgccgcctcgccggcaccaccggctggagcctgcgcaacgccaccctgatcacgggcaccagcttcaccgaggtgccgccggccacgggcgccacctacgagtacgccctccgcgccgtcgaccgctccgccaacgcctccgcgctgtccgcggtgaccagcgtcgtcagcgccgacaggacggcccccgccgcgcccaccgggctcacggccacgtacgacccgtccgccggtgcccggctctcctggtccccggtcagcggggcgagctcctacgaggtgcagcgggccgtcgctcccgagggtccgttcgcctcggtcggcacacctttgcagagcgccgccctgaccgacccgtccgccaccgcgggcacgacctactactaccgcgtgcgggccagggacaacgcgggcaacgcctccgcgtactccgcgaccgtccagctcgacgcccccgaggccaagccgctgccgcccacggccgtctccgccaacggctgggtcgaccgcaacaccgtcggctggcagtacgacggtgacgcgtcccaccggttccacgtgtatgccgccgagtcggccgccggaccgtggacccggctgaccgagacgccggtcaccggccccgcctacgacgattacgcggcgcccgtccgcgaggtgcgccactaccaggtcaggacggtcacggccctcggcacggagtcgaacccgtcggcgaccgcctcggccacccgcaccggcgacgtcaccccgccgcgcatgccgtacggcctggacgcctgggacggcacggacggcgtgcacctcgtctggacgcccaacaccgacgacacggaccactacctcgtcatgcgcagcgcgacgttcggcgcgtgggagcagatcgccgtggtgcgcgagggcacgtacctggacaccggcaccccggccggcgtgcagttcggctacaccgtccgcgccgtcgacgcggcgggcaatgtctcccccctgcccgagcccggctacggcaccgtctacggcaagcgcctgccggtctacgagacgccggccgcgcccgcctcggtcaccgcgacggccgacaacggcaacgtcaaggtggagtggaccgcaagcacgtcgaccgatgtggccggctactacgtctaccgcaccaccggcacggacccgacgtcggcctactcggtctccccgctcatcaccgggacgacgttcacgaacgagaacgtgcccgccggcaagacctggcgctacgtggtgcgcgccgtcagcaagcacagccggtggtccgacttctcgccgatggccgaggtcaccgtgccctgcccggtcctgaccggaccacccacccccagaatcaccgggggcggcaggggcgcggactacgcccagctcagctgggaggccggagcgtgcgaccagggtgcgaccgtctcgtacaacgtctaccggtcgacgtccagctcggacgtcttcacccctgagcgccgcatcgccacgggtgtgacggcactgacgtacaaggaccccggcctggcccgggcgtactactactacgtcgtcaccgccgtggccgccgacggcaccgaatcggccccgcaggcccagcccttcgggatatcgatgatggcgccctga

SEQ ID NO: 238 - DNA, 2223 bp, Streptomyces Sp.
gtgctctccttggccacagccctggccgggctcgctttccccacgaccgcgcacgcggccgtgaactgctcggccggcgtgtggaaggcccagtactacgccaacaccaccctctccggcactccgaaggccaccgtctgcgataccgccatcgccgagaactacggctccggtgacccctccggggtgagcctgccgagcgactacttcggcgtccgctggaccaccacccgcaacttcggctccggcggccccttcgacctgagcgtcgccgtccaggacggcgcccgcgtctacgtcgacggctaccgcaagatcgacctgtggcgcaacgtcagctcgacccagcggaagaccgtccgcctcaccatgccacgcgggacccacaccctgcgtgtggacttcgccgccttcaccggcaccgccaacgtctccttctcctacaagccggtcatcggcgccacctacgacaagaccgcccccctggccccggtcggcgtgaagtccagctactcggcgtccaccctgaagacgaccctgacctggtcccgcaactacgagatggaccaggccggttaccgcgtctaccgccgcatcgccggcagcagcggctggagcctgcgcaactccaccctgatcacgggcaccaccttcaccgacgcgcccccggccaccggcgccgcctacgagtacgccctccgcgccgtcgaccgctccggcaacgtctccgcgctgtccgcggtgacgagcgtcgtcagcgccgacaggacggcccccgccgtgcccaccgggctcaccgccacgtacgacccgtctgccggcgcccggctctcctggtccccggtgagcggggcgaactcctacgaggtgcagcgggccgtcgcgcccgaggggccgttcgcctcggccggcacgcccacgcagagcgccgccctgaccgacccgtccgccgccgtgggcacgacctactactaccgcgtgcgggccaaggacagcgcgggcaacgcctccgcgtactccgcgcccatccagctcgacgccaccgaggccaagccgctgccgcccacggccgtctccgccaacggctgggtcgaccgcaacggcgtcggctggcggtacgacggtgacgcgtcccaccggttccacgtctatgccgccgaggcggccgccggtccgtggacccggctgaccgagacgccggtcaccggccccggctacgacgactacgcggcgcccgtcggcgaggtgcgccactaccaggtccggacggtcacgactctcggcacggagtcgaacccgtcagcgacggtctcggccacccgcaccggcgacgtcaccccgccgcgcatgccgtacggcctggacgcctgggacgccacggacggcgtgcacctcgtctggacgcccaacaccgacgacacggaccactacctcgtcatgcgcaagccgacgttcggcgcgtgggagcaggtcgccgtggtgtgggacgccaagtacctggacaccggcaccccggccggcgtgcagttcggctacaccgtccgcgccgtcgacgcggccggcaatgtctcccccatgcccgagcccggctacggcaccgtctacggcaagcgcctgccggtccacgagacgccggccgcgcccgcctcggtcaccgcgacggccgacaacggcaacgtcaaggtggagtggaccgcgagcacgtcgaccgatgtggacggctactacgtctaccgcacgaccggtacggacccgacgtcggcctacccggtctccccgctcatcaccgggacgacgttcacgaacgagaacgtgcccgccggcaagacctggcgctacgtggtgcgcgccgtcagcaagcacagccggtggtccgacttctcgccgatggccgaggtcaccgtgccctgcccggtcctgaccgggccgcccactcccaggatcaccgggggcggcaggggcgcggactacgcccagctcaactgggaggtcggagcgtgcgaccagggggcgaccgtctcgtacaacgtctaccggtccacgtccagctcggacgtcttcacccctgagcaccgcatcgccacgggtgtgacggcactgacgtacaaggatcccggtctggcgcgggcgtactactactacgtcgtcaccgccgtggccgccgacggcaccgagtcggccccgcaggccgtgccgttcgggatatcgatgatggcgccctga

SEQ ID NO: 239 - DNA, 1164 bp, Bacillus Sp.
gtgaaaaaaatcatctggatacccttagtgctcatccttgccgcagcggtcttatgcttcttctatttccgcacggaagagcctgcggaggttgatagggaaacattaaatgaccctgattttctgaaaaataaagaagcgctgctgtatttctccactgcggctgaccaagacacgttcggcggcggaaaaagctatgccctcttcgccgataaaaaggggcggctctcttcttatcaaatgaaggggcttgagctcggatcggccaaagtgcatgacggcagcgtgctgctggaggacaaaaaaggaatctacaccgttcaaaatggtcttcacacatataaaagaacgtatcagcatacgggagacagcgcgggatatatcgaacggacgaaaggcttttacacgctgtacaattcgggctacgacaagagcggcggcagctaccgctcagagctgtaccgccagattgacggcaggtggaagcaaaacgtcatcccgcactatatccgcgcctcaggctattttaaagatcatcttttcgcgctcacgccgacagatgacgaaaaaggctatcacatacaagacattcaggccgataaagaaaagctccatacaaaatccatcgcgacatggacgtataaagaaggcacgtcagtcgaatcccagctcgccgcggacgacggcgccgtctgctttgtcaccagaggggaaaaagcagaacacatctaccaaatggtgaaagttatgagaaagagcggcactatcaaaacatatgacatcgccgcttataaaaatgacgaacagacgatctatgactccatgccgttcagcttcaaaaaaagctttttcatggagcagcatagcttctatttcgttgacggcttcggaaccgtctaccgcatcaaccctgagaccgggaaaagcaaaaaggccttcaccctccccgcatcacgaatgaaggccgacttcaaagacctgacgcatcaaaacggaaagctgtatctgttcacatacagctacaaaaagcccgccaaaattgaatccttcgacctgaaaacaggcaaaaaactaaacgaccggaccatccccagcctgaaagacatcatcacgccgaaaagccatctcaagctgtatgatgtgcaggtgatggatgggttttga

SEQ ID NO: 240 - DNA, 1164 bp, Bacillus Sp.
gtgaaaaaaattatctggatacccttagtgttcatccttgcgtcaggggtcttatgcttcttctatttccgtacggaagagcctgcggaggttgcgagggacacattaaatgaccctgattttctgaaagataaagaagcgctgctgtatttctccactgcggctgatcaagacacattcggcggcggaaaaagctatgccctcttcgccgataaaaaggggcggctctcttcttatcaaatgaaggggctagagctcggatcggccaaagtgaatgacggcagcgtgctgctggaggacaaaaaaggaatctacaccgttcaaaatggtcttcacatatataaaagagcgtatcagcatacgggagacagcgccgggtatatcgaacggacgaaaggcttttacacgctgtacaattcgggctacgacaagagcggcggcagctatcgctcagagctgtaccgccagattgacggcaggtggaagcaagacgtcatcccgcactatatccgcgcttcaggcttttttaaagatcatcttttcgcgctcacgccgacagatgacgaaaaaggatatcacatccaagacattcaggccgataaagaaaagctccatacaaaatccatcgcgacatggacgtataaagaaggcacgtcagtcgaatcccagctcgccgcggacgacggcggcgtctgctttgtcaccagaggggaaaaagcagaacacatctaccaaatggtgaaagttatgagaaagagcggcgcgatcaaaacatatgacatcgccgcttataaaaatgacgaacagactatctatgactccatgccgttcagcttcaaaaaaagctttttcatggagcggcgcagcttctatttcgttgacggcttcggaaacgtgtaccgcatcaaccctgagaccggaaaaagcaaaaaggccttcaccctccccgcatcacgaatgaaagccgacttcaaagacctgacgcatcaaaacgaaaagctgtatctgttcacatacagctacaaaaagaccgccaaaatcgaatccttcgacctgaaaacgggcaaaaaactgaacgaccggaccattcccagcctgcaagacatcgtgacaccgaaaagccatctcaagctgtacgatgtgcaggtgatgggcgggttttga

SEQ ID NO: 241 - DNA, 1164 bp, Bacillus Sp.
gtgaaaaaaatcatctggatacccttagtgatcatcgccgccgcagcggttttatgcttcttctatttccgcacggaagaccctgcggaggttgcgagagacacattaaatgaccctgattttctgaaagataaagaggcgctgctgtacttctccacggcggctgaccaagacacgttcggcggcggaaaaagctacgccctcttcgccgatgaaaaaggacggctctcttcttatcacatgaaggggcttgagctcggatcggccaaagtgcatgacggcagcgtgctgctggaggacaaaaaaggaatctataccgttcaggacggccttcacacatataaaagagcataccagcatacgggagacagcgcgggatatatcgaacgggcgaaaggcttttacacgctgtataattcgggctacgacaagagcggcggcagctatcgctcagagctgtaccgccagattgacggcaagtggaagcaagacgtcatcccgcactatatccgcgcttcaggcttttttaaagatcatcttttcgcactcacgccgacagatgacgaaaaaggctatcacgtccaagacattcaggctgataaagagaagctccatacaaaatcaatcgcgacatggacgtataaagaaggcacgtctgtcgaatcccagctcgccgcggacgacagcgccgtctgctttgtcaccagaggggaaaaagcagatcacatctatcaaatggtgaaagtcatgaaaaacagcgacgccatcaaaacgtatgacatcgccgcttataaaaatgacgaacagacgatctatgactccatgccgttcagcttcaaaaaaagctttttcatggagcagcgcagcttctatttcgttgacggcttcggaaacgtgtaccgcatcaaccctgagaccggaaaaagcaaaaaggccttcaagctctccgcatcacgaatgaaagccgactttaaagagctgacccatcaaaacggaaagctgtatctgtttacgtacagctacaaaaagcccgccaaaatcgaatccttcgacctgaaaacgggcaaaaggctgaacgacctgaccatcccgaacctgaaagatatcgtgacgccgaaaagccatctcaagctgtatgatgtgcaggtgatgggtgggttttga

SEQ ID NO: 242 - DNA, 1185 bp, Bacillus Sp.
gtgaaaaaaatcatctggatacccttagtgatcatcgccgccgcagcggtcttatgcttcttctatttccgcacggaagaccctgcggaggttgcgagagacacattaaatgaccctgattttctgaaagataaagaggcgctgctgtatttctccacggcggctgaccaagacacgttcggcggcggaaaaagctacgccctcttcgccgatgacaaaggacggctctcttcttatcacatgaaggggcttgagctcggatcggccaaagtgcatgacggcagcgtgctgctggaggacaaaaaaggaatctataccgttcaggacggccttcacacatataaaagagcgtaccagcatacgggagacagcgcgggatatatcgaacgggcgaaaggcttttacacgctgtataattcgggctacgacaagagcggcggcagctatcgctcagagctgtaccgccagattgacggcaagtggaagcaagacgtcatcccgcactatatccgcgcttcaggcttttttaaagatcatcttttcgcactcacgccgacagatgacgaaaaaggctatcacatccaagacattcaggctgataaagaaaagctccatacaaactcaatcgcgacgtggacgtataaagaaggcacgtctgtcgaatcccagctcgccgcggacgacagcgccgtctgctttgtcaccagaggggaaaaagcagatcacatctatcaaatggtgaaagtcatgaaaaacagcggcgccatcaaaacgtatgacatcgccgcttataaaaatgacgaacagacgatctatgactccatgccgttcagcttcaaaaaaagctttttcatggagcggcgcagcttctatttcgttgacggcttcggaaacgtgtaccgtatcaactctgagaccggaaaaagcaaaaaagccttcaagctccccgcatcacgaatgaaagccgactttaaagagctgacccatcaaaacggaaagctgtatctgtttacgtacagctacaaaaagcccgccaaaatcgaatccttcgacctgaaaacgggcaaaaagctgaacgacctgaccatcccaaatttaaaaaacatcgtcacgccgaaaagccatctcaagctgtatgatgtgcaggtgatgggtgggtttgagaaggaaaagcagtcatcataa

SEQ ID NO: 243 - DNA, 1200 bp, Bacillus Sp.
gtgaaaaaaatcatctggatacccttagtgatcatcgccgccgcagcggtcttatgcttcttctatttccgcacggaagatcctgcggaggttgcgagagacacattaaatgaccctgattttctgaaagataaagaggcgctgctgtatttctccactgcggctgaccaagacacgttcggcggcggaaaaagctacgccctcttcgccgatgaaaaagggcggatctcttcttatcaaatgaaggggcttgagctcggatcggccaaagtgcatgacggcagcgtgctgctggaggacaaaaaaggaatctacaccgttcagcacggccttcacacgtataaaagagcgtaccagcatacgggagacagcgcgggatatatcgagcgggcgaaaggcttttacacgctgtataattcgggctacgacaagagcggcggcagctatcgctcagagctgtaccgccagattgacggcaagtggaagcaagacgtcatcccgcactatatccgcgcttcaggcttttttaaagatcatcttttcgcactcacgccgacagatgacgaaaaaggctatcacgttcaagacattcaggctgataaagagaagctccatacaaaatcaatcgcgacatggacgtataaagatggcacgtctgtcgaatcccagctcgccgcggacgacagcgccgtctgctttgtcaccagaggggaaaaagcagatcacatctatcaaatggtgaaagttatgagaaagagcggcgccatcaaaacgtatgatatcgccgcttataaaaatgacgaacagacgatctatgactccatgccgttcagcttcaaaaaaagctttttcatggagcagcgcagcttctatttcgttgacggcttcggaaacgtgtaccgtatcaactctgagaccggaaaaagcaaaaaagccttcaagctccccgcatcacgaatgaaagccgacttcaaggagctgacccatcaaaacggaaagctgtatctgtttacgtacagctacaaaaagcccgccaaaatcgaatccttcgacctgaaaacgggcaaaaagctgaacgacctgaccatcccaaatttaaaaaacatcgtcacgccgaaaagccatctcaagctgtatgatgtgcaggtgatgggtgggtttgagaaggaaaagcagtcatcaaatggtttgtgggagtag

SEQ ID NO: 244 - DNA, 3681 bp, Streptomyces Sp.
gtgcacagaaaacgccccagagccagaaccttcctcgcactcctgacgggcgctctgctcgcagggtcgagcctcagcgccgtacccgccgccgcgcacccggacgagccggccgcggaggagagcttccagcaggtgaccctcgcgaagggcgccgacgcggtcggcgagcccatgtcgctcgccgtgctgcccgaccggcgggtgctgcacacctcgcgtgacggcacgctgcgcatcaccgacgccggcggcgacaccatggtctccggcacgctggatgtctacagccatgacgaggagggtctccagggcgtcggggtcgaccccgacttcgccgagaaccgggccatctacctcttctacgcgcccaagctggacaccccggcgggcgacgccccggagaacggcacggcggccgacttcgccccgttcgacggatacaaccgcctctcccggttcaccctgaacgaggacggcacgctcgacaaggcgagcgagaagaaggtcctcgacgtcaccacctcccgcggcacctgctgccatgtgggcggcgacatcgccttcgacgcggacggcaacctgtatctgtcgaccggcgacgacaccaacccgttctcctccgacggctacacgccgatcgacgagcggcccgaccgcaacccggcgttcgacgcccagcgttcctccggcaacaccaatgacctgcgcggcaaggtgctgcgtatcaaggtcgccgaggacggctcttacaccatccccgagggcaacctcttcgccccgggaaccgagaagacccggcccgagatctacgccatggggttccgcaaccccttccgtatctccgtcgacaagaagacgggcatcgtctacgtcggtgactacggccccgacgccggcgccgcgtccccgacccgcggtccggccggccaggtggagttcgcccgggtcaccgaggcgggcaacttcggatggccgtactgcacgggtgacaacgacccgttcatcgactacgacttcgccaccaaggcgtccggcgcggccttcgactgcgacgcgcccaagaacacctcgccgcacaacacgggtctgacggacctgccgccggcccagccggcctggatcccgtacgacggcggcagcctgcccgagttcggcagcggctccgagtccccgatggcgggaccggtctaccgctacgacgccgcgctcgactccccggtcaagttccccgaggcgtacgacggggacttcttcgccggtgagttcggccgcaagtggatcaagcggatcgagcagggcgaggacggcaccgtcagcaagatcaacccgttcccgtggaccggtacccagcccatggacatggagttcggccccgacggcgcgctctatgtgctcgactacggtctgtcctggttcggcggtgacgagcactccgcgctctaccggatcgagaactccaccggcggcaagtcaccgatcgccgaggccgccgcgaccaagacgtccggcaagtccccgctgaaggtcaccttctcctccgcgggcacccaggaccccgacggcgacgccctcacctacgcgtgggacttcggcgacggcggcacctcgaccgaggccaacccctcgtacacgtacaagaagaacggcacctacaccgcgcggctcaccgtcaccgacccgaccgagcgcaccgcgaccgcgtccgtacggatcgtcgtcggcaacaccgcgcccaaggtgacgctcgaactccccaacgacgggcacctcttcaacttcggggacaccatccccttcaaggtgaaggtcaccgacccggaggacgggacgatcgactgctccaaggtcgtcgtccgctacatcctcggccacgacagccacggccacccaatcacctcggccaacggctgtgagggcaccatcaccgcgcccgccgacaccgagcacgaccccaacgccaatatcttcggtgtgatcgacgccgagtacaccgacggcggaggcggcggccaggcggcgctcaccacgcacgaccaggcgcagctccagccgcgccaccggcaggccgagcacttcaacaactcctccggcatcaagatctacgacaaggcgcccgccaacggcggcaagaccgtcggcgacatcgacaacggcgactggatctccttcaagccctacaacctgaccggatccaagacgctcaccgcccggatctcctccgggggcgccggcggattccttgaggtacggaccggctcggccaacggcaacctgctcggctccgcgccgatcccggtcaccggcggctgggagaccttccaggacatcgacgtaccgctgcgttccgtaccgaagcagaccaccgaactgttcctggtcttcaagggcggcgccggcgcgctgttcgacctggacgacttccagctctccacggccgtgcccggcaagaccgagaagcgggtgctggtcttctccaagaccggcggcttccgccacgactcgatccccgcgggcatcgccgcgctcaaggagctcggcaagaccaccgggatcaccgtcgacgccaccgagacggccggccagttcaccaccaacaacctggcccggtacgacgcggtggtcttcctctccaccaccggtgacgtcctcaacgccgaccagcagaaggcgttcgagaactatgtcgccaccggcggcggctacatgggcgtgcacgccgcggccgacaccgagtacgactgggccttctacggcggtctggtgggggcctacttcgactcccacccgcagatccagccggccaccgtacgcgtcgaggaccacgaccacccgtcgaccgcccacctggacgacgagtggcagcgcaccgacgagtggtacaactaccgcaccaacccccgggatcaggcccgcgtcctcgccaccctggacgagaccacctaccagggcggcaacatgaagggcgaccacccgatcgcctggtgccagacgtacgagggcggccgctccttctacaccggcggcggccacaccaaggagtcgtacgcggacgacgccttccggcagcacctgctcggcggactgcggtacgcggccggccaggtgaaggcggactgcaagccgaagaccggctaccgggatctcttcaacggcaagacgctggagggctggaagcaggccggaccgggcaagttcaacgtcgtggacggagaactgcgcaccgagggcggcatgggtctgctgtggtaccaggccaaggagctgaagtcctactccctgaagctggactggaagatggacggggacgacaactccggtgtcttcgtgggcttcccggcctccgacgacccgtggtccgcggtcaacaaggggtacgagatacagatcgacgccaccgactcggccgaccgcaccaccggcgccgtctacggcttcaagtcggccgacatcaaggccagggaccaggttctgcggcccccgggccagtggaacaactacgagatcaaggtccagggtgagcgtctgcagatcttcctcaacggcgtgaagatcaacgacttcaccaacaccgacccggagcgcagtctcaagaacggctacatcggcctccagaaccacggggccgacgaccaggtgtccttccgggacatccagctcaaggagctgcccgccgcctag

SEQ ID NO: 245 - DNA, 3732 bp, Streptomyces Sp.
gtgcaccgtaaacgcacccgagccagaaccctcctcgcgctcctgacgggcgccatgctcgcggcagcgagcctcagcgccgtgcccgccacagccgccgattccggcgcggcggccgtcgcccacgaccccgggcacgacgaccccggccatgacgatcccgccgccgccgaggacttccagcaggtgaccctcgccaagggcgccgacgagaccggtgagcccatgtcgctcgccgtgctcccggaccgcagtgtgctgcacacctcgcgggacggcacactccggatcaccgacgccggcggcgacaccacgatcgccggcaagctggacgtctacagccatgacgaggaagggctccagggcgtcggtgtcgaccccgggttcgccgagaaccgcgccatctacctctactacgcgcccaagctcgacacacccgccggcgacgcccccgagaacggcacggccgccgacttcgcccccttcgacggcatcaaccgcctctcgcgcttcacgctcaacgaggacggcacgctgaacgcggcgagcgagaagaaggtcctcgacgtcgccgcgtcgcgcggcacctgctgccacgtcggcggcgacatcgacttcgacgcggacggcaacctgtacctgtcgaccggtgacgacaccaacccgttcgcctccgacggctacaccccgatcgacgaacggaccgaccgcaaccccgcgttcgacgcccagcgcagcgccggcaacaccaacgacctgcgcggcaagctcctgcggatcaaggtcgcggaggacggttcgtacaccatcccggagggcaacctcttcgctccgggcacggagaagacccggcccgagatctacgcgatgggtttccgcaacccgttccgcatctcggtcgacgagaagaccggcatcgtgtacgtcggtgactacgggcccgacgcgggcgccgcgtcgccgacccgcgggccgtccggaacggtcgagttcgcgcgggtcaccgaggcgggcaacttcggctggccgtactgcgtcggcaacaacgagccgttcatcgactacgacttcgcgaccaagcagtccggcgaggccttcgactgctcggctcccaagaacacctcccggaacaacaccggcctgaccgacctcccggccgcgaagcccgcgtggatcccctacgacggcggcagcgtgcccgagttcggcaccggctcggagtccccgatggccgggcccgtctaccgctacgacgcggacctcgactcgccggtgaagttccccgaggcctacgacggcgacttcttcgccggggagttcggccgcaagtggatcaagcggatcgagcagggcgaggacggaacggtcgagaagatcaacccgttcccgtggactggcacccagatcatggacatggacttcggccccgacggcgcgctctacgtcctggactacggcctctcctggttcggcggcgacgagttctccgcgctctaccgcatcgagaacgccaccggcggcaagtcaccgatcgccgaggccaccgcgagcaagacctccggcaaggctccgctgaaggtggccttctcctccgccggcacccaggacccggacggcgacgagctgtcgtaccagtgggacttcggcgacggctccacctccaccggggccaaccccacgcacacgtacaagaagaacggcacctacagcgcacggctcacggtcaccgaccccaccgaacgcaccggcacggcgtccgtccgggtggtcgtcggcaacaccgcgcccacggtgacactggagctccccgccgacggaaccctgttcgacttcggtgacacactgcccttcaaagtgaaggtcagcgaccccgaggacggcacgatcgactgctccaaggtgacggtccgctacgtcctcggccatgacaaccacggccacccgatcacctcggcgaacggctgcgagggcaccatcaccgcccccgcggacgccgagcacgaccccaacgccaacatcttcggtgtgatcgacgccgagtacaccgacggcgggggcggcggccaggccgcgctcaccagccacgaccaggcgcagctccagccccgccaccggcaggccgagcacttcaccgggtcctccggcgtcaatgtgatcgagaaggaggccgccaacggcggcaagaccgtcggtgacatcgacaacggcgactggatctccttcaagccgtacaacctgaccggttcgaagacgctcacggcccgggtctcgtccggcggctccggcggcttcctggaggtacggaccggctccgccaagggcaccctgctgggttcggcgccgatcccggtcaccggcggctgggagaccttccaggacgtggacgtgcctctgcggtccgtgccgaagaagaccaccgagctgttcctggtcttcaagggcggctccggagcgctgttcgacctggacgacttcgagatatcgacgaaggcccccggcaagaccgagaagcgggtcctggtcttctccaagaccgcgggattccgccacgactcgatctccgcgggcgtcgccgccctgaaggagctgggcaagaccacggggatcaccgtcgacgccacggagacggcggcccagttcaccaccaacaacctggcccgctacgacgcggtggtcttcctctccaccaccggtgacgtcctcgacgcggagcagcagaaggcgttcgagaactacgtcgccaccggcggcggctacatgggggtgcacgcggcggccgacaccgagtacgactgggccttctacggcgggctcgtcggcgcgtacttcgactcccacccggcgatccagcaggccaccgtgcgggtcgaggacaaggaccacccgtcgaccgcccacctggacgacgagtggcagcgcaccgacgagtggtacaactaccgcaccaacccgcgcgagaaggcccgtgtcctcgccaccctggacgagaccacctaccagggcggcaccatgaagggcgaccacccgatcgcctggtgccagacctacgggggcggccggtcgttctacaccggcggcggccacacgaaggaatcgtacgaggacgcggccttccgccggcacctgctgggcgggctgcgctacgcggccggccaggtgaaggccgactgcgagccgcggaccggctaccgggacatcttcaacggcaagacgctggagggctggaagcaggccggaccgggcaagttcaacgtcgtggacggcgaactgcgctccgagggcgggatgggactcctctggtaccaggccaaggaactgaagtcctactcgctcaagctcgactggaagatggagggcgacgacaactcgggcgtgttcgtgggcttcccggcctccgacgacccgtggtcggcggtgaacaaggggtacgaggtacagatcgacgcgaccgacgccccggaccgtacgacgggcgccgtctacggcttcaagtccgccgacgtgaaggccagggaccgggtgctccggccgcccgggcagtggaacgcgtacgagatcaaggtccagggcgagcggctccaggtcttcctcaacggtgtgaagatcaatgacttcaccaacacggacccggcgcgcagcctgaaggacggctacatcggcctccagaaccacggggccgacgaccaggtgtccttccgtgacatccagctcaaggaactgccctcctcctag

SEQ ID NO: 246 - DNA, 3678 bp, Streptomyces Sp.
gtgcccagaagacgtcatagatccagatccctcctcgcactcgtcgccggcgcgctgatagccggcaccatctccgccgtccccgccgccgcgcacccggacgatccgcacccgacggacgacatgttccagcaggtcgccctcgccaagggcgccgacgaggtgggcgagcccatgtcgctcgccgtcctgccggaccgccaggtcctgcacacctcgcgtgacggcacgctccgcatcaccgacgccgcaggcgacaccaaggtcgcgggcaagctcgacgtgtacacccacgacgaggaaggcctccaaggcgtcgggatcgaccccgacttcgccgagaaccgggcgatctacctctactactccccggtgctcgacacccccgccggagacgcgcccgagacgggcacggctgccgacttcgcccccttcgacgggtacaaccggctctcgcgcttcacgctgaaggaggacggcaccctcgacaaggccagcgagaagaaggtcctcgacatcgagaccaaccgcggcctgtgctgccacgtcggcggcgacatcgccttcgacgcggacgggaacctgtatctgtcgaccggcgacgacaccaaccccttcgcctccgacggctacacgccgatcgacgaacgccccaaccgcaacccggccttcgacgcccggcgcacctccggcaacaccaacgacctgcggggcaaggtcctgcggatcaaggtcgccgacgacggctcgtacaccatccccgagggcaacctcttcgcccccggcacggccaagacccgccccgagatctacggcatgggtttccgcaaccccttccggatcaacgtcgaccagaagaccggcatcgtctacgtcggtgagtacggccccgacgcgggcgccgcgtccgagacccgcggcccggccggccaggtcgagttcgcccgtatgacggaggccggcaacttcggctggccgtactgcaccggcgacaacgacgcctaccgcgactacgacttcgcgaccggcacctccggcccggccttcgactgcgccgcgccgaagaacgactcgccgcacaacaccggcctcaccgacctgccgccgtcccaggccgcctggatcccctacaacgggaacagcgtcccggagttcggcgacggctccgagtctccgatgggcggcccggtctacaacttcgacccggacctggactccccggcgaagttccccgaggagtacgacggcgacttcttcgccggcgagttcgggcgcgagtggatcaagcgcatcgagaaggacgccgacggcaccgtctccgccatccacgacttcccgtggaccggcacccaggtgatggacatggagttcggccccgacggcgcgctctacgtactcgactacggccgcgcctggttcggcggcgacgagaactcggccgtctaccggatcgagaacatcgccaacggccgggccccggtggccaaggccacctccagcaagacgtccggcaaggcgccgctgcgggcgaacttctcctccgcgggcaccgcggaccccgacggtgacgagatcacctacgcctgggacttcggcgacggtggcaagtccaccgagcccaacccgagctacgtgtacaagaagaacggcacctacaccgccacgctgaccgccacggaccccgacgggaacaccggcaattcctccgtccgggtcgtggtcggcaacaccgcgcccaaggtgacgctcaccgtgcccgccgacggagccctgttcaagttcggcgacaagctgcccttcaaggtcacggtcaccgaccccgaagacggcccgatcgactgctccaaggtcaccgtcaactacatcctcggccacgacagccacggccacccgatcacctcggccaagggctgtgaaggcaccatcaccgccccggcggacggcgagcacgaccccaacgccgacatcttcggtgtcatcgacgccgagtacaccgacggcggaggcggcggccaggccgcgctcaccacgcacgaccaggtgcagctccagccccgccaccggcaggccgagcacttcaccaaccagtcgggcatcaagacgtacgacaaggcgtcggccaacggcggcaagaccgtcggcgacatcgacaacaacgactggatctccttcaagccgtacaacctgaccgggtccaagaccctcaccgcccgggtgtcctccggcggttcgggcggattcctcgaagtgcgtacgggctccgccaccggcacgctcctcggctccgcgccgatcccggtgaccggcagctgggacaccttccaggacatcgacgtaccgctgcgctcggtgcccaaggccaccacggaactgttcctcgtcttcaagggcggtcagggcgcgctctacgacctcgacgacttcgagatcagcgagcaggccgccggcaagacggagaagcgcgtcctcgtcttctccaagaccgccggattccgtcacgacgccatcccggaggggatcgcggcgctgaaggaactgggcaagagcagcaacatcaccatcgacgccaccgagaccgcggcgcagttcaccaccaacaacctcgcccggtacgacgcggtggtcttcctctccaccaccggtgacgtcctcaaccccgagcagcagaaggccttcgagtactacatctccaccggcggcgcctacatgggcgtgcacgccgcgtcggacaccgagtacgactggccctactacggcaagctcgtcggtgcctacttctccggtcacccgcagatccagcaggccaccgtacgggtcgaggaccacgagcacccgtcgaccggtcacctggacgacgagtggcagcgcacggacgagtggtacaactaccgcgacaacccgcgctcgaacgtgaaggtcctcgccaccctggacgagacgacctaccagggcggcaccatgaagggcgaccacccgatcgcctggtgccagacctacgagggcggccggtccttctacaccggcggcggccacaccaaggcctcgtacgccgaaccggccttccgtgagcacctgctgggcggtctgcgctacgcggccggccaggtgaaggccaactgcaagcccaacaccggctaccgggacatcttcaacggcaagaccctggacggctggaagcaggcgggaccgggcaagttcaacgtcggtggcggcgagctgcacaccgagggcggcatgggcatgctctggtaccaggccaaggaactgggctcgtactcgctgaagatggactggaagatggacggggacgacaactccggtgtcttcatcggcttcccggcctccgacgacccgtggtcggccgtcaacaacggctacgagatccagatcgacgccacggacgcggcggatcgcaccaccggcgcgatctacgggttcaaatcggccaacatcaaggccagggaccaggttctgcggcccccgggccagtggaacagttacgagatcaaggtccagggtgagcgcgtccaggtcatcctcaacggagtcaagatcaacgacttcaccaacacggatccggtccgcagcctgaaggacgggtacatcggccttcagaaccacggtgccgacgaccaggtcgcgttccgcgacatccaactgaaggaactggcctcctag

SEQ ID NO: 247 - DNA, 3717 bp, Streptomyces Sp.
gtgcacacaacccgcagcggcagccgcaccaggctccgcatccgaaaatccctcgccctgttcaccggcggtctcctggccgccgccaccctcagcctgagcgccgcgtcgggcaccgccgccgcccacgaggagcccgcgccggcaccggccgccgaggacttccagcaggtcaccctcgccaagggcgccgccgagaccggcgagcccatgtcgctggccgtgctccccgaccgcagcgtgctgcacacctcgcgcagcggcgagctgcgcatcaccgacagtgccggcaacaccaggatctccggcgtcatcccggtctactcgcacgacgaggagggcctccagggcataggcgtcgacccggacttcagcgagaaccgggcgatctacctctactacgcgcccccgctggacaccccggcgggcgatgcgcccgagaccggcaccgccgccgacttcgcccccttcgacggggtcaaccggctctcccgcttcgtcctcaacgaggacggcacgctggatctcggcagcgagaagaaggtcctcgacgtcaagacgtcccgcggcatgtgctgccacgtcggcggggacatcgacttcgacgccgacggcaacctgtacctgtcgaccggcgacgacaccaaccccttcgcgtccgacggcttcactcccatcgacgaacgcccggaccgcaacccggcgttcgacgcccgccggtccgcgggcaacagcaacgacctgcgcggcaagatcctccgcatcaaggtcgcggacgacggctcgtacaccgtcccggacggcaacctcttcgcgccggggacggacaggacccgtcccgagatctacgcgatgggcttccgcaacccgttccgcttctccgtcgacaaggcgaccggcatcgtctacgtgggcgactacgggccggacgccggcgcggccgaccccaagcgggggcccgcgggacaggtcgagttcgcccgggtcacgaaggccggcaacttcggctggccgtactgcaccggcgcgaacgacccgtacatcgactacgacttcgccaccaagacctccggcgcggccttcgactgcgcggccccgaagaacacctcgccgcacaacaccggcctcgtcgacctgcccccggcccaggccgcctggatcccgtacgacggcgggtccgtcccggagttcggcaccggctcggagtccccgatgggcggaccggtctaccactacgacgcggacctcgactcgcccgtcaagttccccgaggcgtacgacggggacttcttcgccggtgagttcggccgccagtggatcaagcgcatcgagcaggacgccgacggcaaggtgcagtccatcaacgacatcccgtggtccggcacccagatcatggacatggccttcggacccgacggggcgctgtacgtcctcgactacggcctctcctggttcggcggcgacgagaactccgcgctctaccgcatcgagaacgccaccggcggacgctccccgatcgccgaggccacgtccgacaagacctcgggcaccgcgcccctgaaggtgcggttctcctccgcaggcaccaccgacggcgacggcgacacgctcacctacgcgtgggacttcggcgacggaggaacctccacggccccgaaccccacgtacacgtacaagaagaacggcacctacaccgctaccgtcaccgccacggacccctcgggccgcaccggatcggccagcgtgcatgtgaccgtcggcaacaccgcacccacggtgaagctggaactccccggcgacgggcagctgttcaccttcggtgacgccatcccgttcaaggtgaccgtcaccgaccccgaggacggcacgatcgactgctccaaggtcgaggtccgcttcgtcctcggccacgacagccacggccaccccatcacctcggagcacggctgcaccggcaccatcaagaccgagatggacggcgggcacgaccccaacgccaacatcttcggcgtcatcgacgcctcgtacaccgacggcgggggcggcggccaggccgcgctgaccggccacgaccagtcgcagctccagccgcgccaccgccaggccgagcacttcaccgactcgtccggcatcaagacctacgacaaggcgaacgccgaaggcggcaagaccgtcggcgacatcgacaacgacgactggatctccttcaagccgtacatcctcggcgactccaccaagctcaccgcccggatctcctccggcggagcgggcggcttcctcgaagtgcgcaccggctcgccgaccggaaagatcctcggctccgcaccggtgccggtgaccggcggctgggagaccttccaggacatcgacgtcccgctgcgcggcgtcccgaagcaggccaccgaactcttcctggtgttcaagggcggcgagggcgcgctctacgacatcgacgacttcgagctctccaacaccccgcccgacaggaccgccaagcgcgtcctggtcttctccaagaccgccggcttccgccacgacgcgatccccgaagggatcgccgcgctgaaggaactcggcaaggacagcaacatcacggtcgacgccaccgaggaggcgggccagttcaccaccgccaacctggcccgctacgacgccgtcgccttcatgtcgacgaccggtgacgtcctcaacgccgaccagcagaaggcgttcgagaactacatcaggaccggaggcggctacctgggcgtccacgccgccgccgacaccgagtacgactggtcgttctacggcggactcgtcggcgcctacttctccagccaccccgctgtccagcccgtcaccgtccgcgtcgaggaccacaagcacccggccaccgcccacctgggcgacgcatggcagcggaccgacgagctgtacaactaccgcaccaacccgcgcgacaaggtgaaggtcctcgccacgctcgacgagaccacctacaccggcggcaccatgaagggcgaccacccgatcacctggtgccagacctacgagggaggccggtccttctacacgggcctcggccacaccaaggagtcgtacgccgacgcggacttccgcaagctcctcctgggcgggatgcggtacgccgccggccaggtcaagggcgactgcaagcccagcaccggctaccggtcgatcttcaacggcaagacgctcgaaggctggaagcaggcgggccccggcacgttcgacgtcgtcgacggcgaactgcgctccgaaggcggcatgggcctgctgactcaccaggccaaggagttgacgtcgtactccctgaagctcgactggaagctggcgggcgacgacaactccggcgtcttcgtcggcttcccggaatccgacgacccctggtccgcggtggacaacggctacgaggtccagatcgacgcctccgacgccgtcgaccgcaccaccggctccgtctacaccttcaaagcggccgacatcaaggcacgcgaccgggtgctgaggccgcccggccagtggaacagctacgagatcaaggtgcgcggtgaacggctccaggtcttcctcaacggcgtgaagatcaacgacttcaccaacaccgacccggtccgcagcctcaaggacggctacatcggcctccagaaccacggggccgacgaccaggtgtccttccgcaacatccagctgaaggaactgcccacgacgtag

SEQ ID NO: 248 - DNA, 3717 bp, Streptomyces Sp.
gtgcacagaacccgaagccggaccagatcaacgctccgcgtccgtaaatccctggccctcctcgccggcgccctcctcgccgccgccaccctcgccctgggcgccacccccggcaccgccgccgcccacgaggtacccgccccggccccggctgccgaggacttccagcaggtcaccctcgccaagggggtcgccgagaccggtgagcccatgacgctggcggtgctcccggaccgcagcgtcctgcacaccgctcgcggcggcgaactgtggctcaccgacaacggcggcgacaccacgctcgccggcaccatccccgtctactcgcacgacgaggaaggcctccagggcgtcggagtcgacccggacttcagcgagaaccgggcggtctacctctactacgcgcccccgctggacaccccggccggggacgcccccgagaacggcaccgccgccgagttcgccaagttcgacggagtcaaccggctctcgcgcttcgtcctcaaggaggacggcacgctcgacatggccagcgagaagaaggtcctcgacatcccgacctcgcgcggcatgtgctgccacgtcggcggcgacatcgacttcgacgcgcagggcaacctgtacatgtcgaccggcgacgactccaacccgttcgcctccgacggctacgccccgatcgacgaccggccggaccgcaaccccgcgttcgacgcccgccgctccgccgggaacaccaacgacctgcgcggcaagatcatccgcatcaaggtcgcggaggacggcacgtacaccgtccccgacgggaacctcttcgcgccgggcacggacaagacccgtcccgagatctacgcgatgggcttccgcaaccccttccgcttcaccgtcgacaagaccaccggcatcctgtacgtcggtgactacgggcccgacgccggtgcggccgacccgaagcgcggacccggcggacaggtggagttcgcccgcgtcaccgcacccggcaacttcggatggccgtactgcacgggcgacaacgacccgttcgtcgagtacgacttcgcgacgaagacctccggtgaggccttcgactgcgccgcccccaagaacacctcccggtacaacaccgggctggtcgacctgcctccggcccagcccgcctggatcccgtacgacaacgggtccgtgcccgagttcggcaccggctcggagtccccgatgggcggacccgtctaccactacgacgccgaccttgactcgcccgtgaagttccccgaggagtacgacggcgacttcttcgccggcgagttcggccgcgcgtggatcaagcgcatcgagcaggacgccgacggcacggtgcagtccatcaacgacgtgccgtggtccggcacccagatcatggacatggccttcgggcccgacggcgcgctgtacgtcctggactacggcacgggctacttcggcggcgacgagaactccgctctctaccggatcgagaacgccaccggcggacgctcaccgatcgcggaggcgaccgcgaacaagacctcgggcaccgcaccgctcaaggtcgccttctcctccgccggcaccaccgacggtgacggggacgcgctcacctacaactgggacttcggtgacggcggtacgtcgtccgcggccaaccccacgtacacgtacaagaagaacggcacctacaccgcgaccgtcaccgccacggaccccaccggccgcaccggatcggccaacgtccatgtgacggtcggcaacaccgcacccgtcgtgaacctggaactgcccggtgacgggcagctgttctccttcggagacgagatcccgttcaaggtgaccgtcaccgatcccgaggacagcaccatcgactgctccaagatcgaggtccgcttcatcctcggccacgacgcccacggccacccgatcacctcggcccacggctgcgaaggcacgatcaagaccgagatggacggcgggcacgaccccaacgccaacatcttcggagtcatcgacgcctcgtacacggacggcggaggcggcggtcaggcggcactgtccggtcacgaccagtcgcagctccagccgcgccaccgccaggccgagcacttcaccgactcgtccggcatcaagacctacgacaaggcgaacgccgagggcggcaagaccgtcggcgacatcgaaaacgacgactggatctccttcaagccgtacatgctcggtgactccaccaagctcaccgcccggatcgcctccggcggagcgggcggcttcctcgaagtccgctcgggctcggccgacgggaagatcctcggctccgcacccgtcccggtgaccggcggctgggaggtcttccaggacatcgacgtccccctgcgcggcgtcccgacgaaggcgaccgaactcttcctggtcttcaagggcggcgacggcgccctctacgacctcgatgacttcgagctctccaacagcgcgcccgacaagaccgccaagcgggtcctggtcttctccaagaccggcggcttccgccacgacgcgatccccgagggcatcgccgcactgaaggaactcggcaaggacagcaacatcacggtcgacgcgacggaggaggccggccagttcaccacctccaacctggcccgctacgacgccgtggtcttcatgtcgaccacgggtgacgtcctcaacgccgaccagcagaaggcgttcgagaacttcgtgaccaccggcggcggttacgtcggcgtgcacgccgcagccgacaccgagtacgagtggccgttctacggcggactcgtcggcgcgtacttcgacagccaccccgccatccagcccgtcaccgtccgggtcgaggaccacaagaacccggcgaccgcccacctgagcgaagcctgggaccgcaccgacgagttgtacaactaccgcaccaacccgcgcggcaaggtcaaggtcctcgccaccctcgacgagacgacctacaccggcggcaacatgaagggcgaccacccgatcacctggtgccagagctaccagggcggccgctccttctacaccggcctcggccacaccaaggagtcgtacgcggacccggacttccgcaaggtcctcaccggcgggctgcgctacgcggccggccaggtgaaggccgactgcaagcccgacaccggctaccgcccgatcttcaacggcaagacgctcgaaggctggaagcaggcgggccccggcaagttcgacgtcgtcgacggcgagctgcgctccgaaggcggcatgggcctgctcacctaccaggccaaggagctgaagtcgtactcgctgaagctcgactggaagctggcgggcgatgacaactccggcgtcttcgtcggcttcccggagtccgacgacccgtggtccgcggtggacaacggctacgaggtccagatcgacgccaccgacgcccccgaccgcaccaccgggtccgtctacaccttcaagtcggccaacaccaaggcccgcgaccaggtcctccggccgcccggccagtggaacagctacgagatcaaggtccagggtgaacggctccagatcctcctcaacggagtgaagatcaacgacttcaccaacaccgatccggcccgcagcctcaaggacggctacatcggcctccagaaccacggggccgacgaccaggtgtccttccgcaacatccagctgaaggaactgccctccgcatag

SEQ ID NO: 249 - protein, 250 aa, Bacillus Sp.
MMCKKLFKAVLPFALSFTMVLSFSGMNVKAKEKETARYAKEIADLQQGTTPQDVLQSAKELAKQKHVSTEAILKQFHQEITADKVQGNVIVSKEGLSAMGGSSGTKKLPKSTKGNIYYTNSYTAYYNHGHVGMYSSADKIVESVPGDGVRQIAYNGREVEDNSIVQTVKVTDAQKQAAADWAVSRVGDEYSFNFVNNRNTGHEGAKNCSKLLWSAFLLKAGIDIDSNGGLGVYPRDITSSSYTTTILTIH

SEQ ID NO: 250 - protein, 387 aa, Bacillus Sp.
MKKIIWIPLVIIAAAAVLCFFYFRTEDPAEVDRDTLNDPDFLKDKEALLYFSTAADQDTFGGGKSYAIFADEKGRLSSYHMKGLELGSAKVHDGSVLLEDKKGIYTVQGGLHTYKRAYQHTGDSAGYIERTKGFYTLYNSGYDKSGGSYRSELYRQIDGKWKQNVIPHYIRASGFFKDHLFALTPTDDEKGYHVQDIQADKEKLHTTSIATWTYKEGTSVESQLAADDSAVCFVTRGEKADHIYQMVKVMKNSGAIKTYDIAAYKNDEQTIYDSMPFSFKKSFFMERRSFYFVDGFGTVYRINPKTGKSKKAFALPASRMKADFKELTHQNGKLYLFTYSYKKPAKIESFDLKTGKKLNDRTIPNLKNIVTPKSHLKLYDVQVMGGF

SEQ ID NO: 251 - protein, 182 aa, Bacillus Sp.
MKRFITRASGNTISKKLVLMMLPMVLMILMITPSNDVSAANLSRAGSLKGVNLFNGSWTVAIQAANLQYVSAEPSGNVVANRNAVNEWEKFELIPTGELYTFALKAKSNGKYVSFEPNGRVVADRTSIGAWEKFILYNGGDNRIYVLQALSNGRFISANGGRELTANSYVAGSWERFVIVYF

SEQ ID NO: 252 - protein, 971 aa, Bacillus Sp.
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQTIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKPQFFNTFTLQGTYTGTAAKGEYEDWKTITQNVNDTLKRLSAKEWTGYKTVTAYFVNYRVNTSGQFEYDVVFHGINTEEGAENKAPVAVINGPYSGNVNEAISFTSDGSKDEDGKITSYKWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 253 - protein, 782 aa, Bacillus Sp.
MKLKRGLLFICTSTMLAIPSMASAKNNDVPFYNGQNDSFLTSLNLQLPGKYYRPGSGYAAKESLYRADVHFPAVYNGSFNWDNPRENLVQAEDTSEPYIRIANEGYLNSKVPAGDRMVTEVERVNNSVISSKYWGNPEFVLENMDKHMIQTYESFRELGQFYWIRDIAYLSGGYAGASGVGNINKYSLWYVRTSKPQVKDFQAMSGKKDIPVKFTFKGFEYVSKNKGYNDRDPNGTTVNPYQKAAGERNRVKWMLDITKDGETVYHQENYLRSTPQKDNQKPNEGDAGQFKKEDITWQPQLCGQYTAKIKVLDAVQRESNEKAVDFTIDGNCGTEVTPNPDPGDEDDFKYKIDFSADRIEGETAREGKNIKTRVDVSRDNFKLERDQYRAKVNNNINKSQQEINSTESDRDSAQSSLSYCRRNPIHEVDAEGKDHYYDRDCSWEENKLDSAASKLDNARQKLEKEKNKIKKLDVLEEKYMNPETVVVLKHNGQQVALQKVRLTEGEKKTLNLDWQHKGKGTIQAEINPAGNRIDIEETTYKNNPIKTAIYEPSKEKAMCGVTSVKGVVETVSERVSKEDITGAMYYETLTGSIGNLAPSKLHSGYGFSYEVNGKYKNDWNANYPGVFTAAKAQYPFADEGLKSTQDLEKKELKDTTAKFLPKNMYLSEATGHVFDSKRPTKSLYWDGQEKIIDGGQKWYSPLKTKNGVYTFNVETAPAGINEMSLCLTEQVEIKGVAYDDFIKRRVFPDDPFPGGSGVGWNWVGKEDVLYKLTDWYYMRNRK

SEQ ID NO: 254 - protein, 1418 aa, Bacillus Sp.
MWFRRSFSLLFVVMLLFGSLADFVSIGHAESTSDQKQAQEKKTDDVTVLQEKSDLKSTGTNPSEVVVANGKKGSELFDFEAFIKPSDIVDGTAPFDSNDEAGNDSSPNNGIVRTFDTVTYPLKVTINPKKNETLKNIKMKITGTLENGITNKRVNAKFAVGGKEDLEKGIVSFDMEYTLKETGNSLMIPVTVEVQGAEHGLKLKPNIKIQVISVDGKDIANENVSQSFDGISPVTTSGKVNVKARFTASYGGMPRLDYKVYDPNAKEDDRTIIYPVALDLFVNNLPNRTDLRGATFPAGKINYHFNFSGKVDWDYKSLGAETLNFEGRDKPIKIFNYQAIDKIVDKVPQEGTESFEIGMKGYKDPRTETANSPKSYIPKDIWNASDIDKYTIDSVWDSGTVRLNKPEITKDRVGYTGSIEDYVIGSTFPTMMSRPGYSVIPTFGKNEKAFSSTRFLIHSTNEYYPVLGKNNKDNLPNNVFYYLEFVIDSYEDGKGNTIPYNTVGRYTLTERNNPKGAYSIQTTFHTTDHKELGTPNVGYSAVSKGDPTVIVGQNVKVVSHLNVRAVTEGGTTMIYKWNTDSFYLSKNSAETARKNMLNEGYPNTSAGRVTNSDKQKIYFGISKKGDNSFETLTQNKDEDYDWYSTYDEAKKQGEVAAIKNDINASMGDGEVVAWNIPLEVKTKKIGSVNEKGTPNITVTDSIVYPSADRKVGYRVRGEGKYNNFTEYDEKGNITKLQSPVGSTVNFETLGIMNGETSSDVKTNKNTYYSSDNVSVTVDNLVKLPDAMDYNSLDEKVEMRVKIPKGLDYVVGSAKYGDQYIEPKIEQQNDGSNHLIWHDTLTRGNKTLKKINFETRINPVLLPQGNQVGLEITNVLSSAMDTRAEKFRTSSKNISVVKIGMVGVSETIEKVTGKKNSDYVVGVQPYTTIKDESHIKALTYVPRNKDHNGSAFNGVTFLRQIALENANNKNVEIWLNNSFVESNNPNKIDLKSNGWYRYTGEQDLSKVVSILLYINDSLSSSDIVKMNLVYGTHKNEFGDFYVSKTVVNTSVDYKLSPVSNQVKYTIVADANLGLRKIRIDTAPADIGLPVIVRLDKDIIYEDSNKSNVAVNLYDKSDNKLVDSKVYTIQELPEEIKFKVDPKFLKKNNKRNYEVRFEKVNKESIFIVDGKGKVDTDGYTSSEETVKANTKASTELKYKGVIMTEREVGKEMEVFYETLTIPLKQLPKQKTGYGFELKPLVSYNNELAVSYDVKTNALVDKRLIDSHLNYEKKGDQFVVPLEEAEKTGSTDKKNTDYLFELPHINVEQKTGNLFTDQQVKDHDPRIKNAIKDGKRKLYVPIWADLGEYNVLIVSGIPIGANKVNFEVTQPLNLYAYMYGTIGSKTLEDDELLLEPVDPKNPFSNGKPPGWSDVDVAWLKQ

SEQ ID NO: 255 - protein, 163 aa, Massilia Sp.
MAIDVYLQIDGIKGESTDTAHKDWIECRSVQWEVLQPKSATASTGGGHTAERTEHKDIVVSKLADLATPLLLQNCSSGKTIPKAKFEFLRADGQGERIKYFEIELENVLISNVAPSVNAGDILSESLALKYSKVKWKYTQQKVGGGSGGNTSGGWDLSANKTA

SEQ ID NO: 256 - protein, 1018 aa, Massilia Sp.
MASKNISQLVSSDGNSSAPATSAPGCFVHDGESIEGFPNKWGKIFSDPHKGNQVEFYFTGDQYFSTVAKAILDAKETVFITGWQVNFDVELTSEMTLYQCLETAIDKNPKLQIYVMPWLSPKVGVDTGDFETMLAVFQLNSGLPAPARAFALPAIAQSDQKGGLGIGFSHHQKLVVIDNKKAFVGGIDLAYGRRDNGRFSLSHDGRVGNELYNTCIPAVHQMTKVEQGKYLTRAELLAACFDGKFGKISTFATSAPAEPIAKLQDKLQVISDAGADLTKRISDKWNSSKLLPEFVGKLADMPVDAAQTASRWAFSRLDASVVDKIDGLRTMGTAHATDAETALVAWLNHTSLERLPASLRATTVELIETFTIATLSYLSNMANTRSARYENLRNLRKIVPASGKVISTSQPRMPWHDVHCSIVGPSVSDLSRNFIQRWNGLAVRYERSHGRIVRPHALRQVFASLGLPSIAPVKLPRIAPAALPSTQARPGKAWVQVLRSAPVRLLADEKAGTAHKSDSAPSPTIAENNCLKAMLTAISGAQKFIYIEGQFFQSAHGGKNTEMESIAGPMQTLLDVTKTRGYKKYAEQLGIKGVPPQKMLAKLRWSQIDDVKADIQGGGADFINDLNAIIANHASIEATRALGPADKAIANPIGEALALRIEGAIQDGLPFHVYLIVPVHPEGTLNTLNIMTQLHLTMQSLVFGRFSLVNRIRRALLVRDLRMSKKMTLTDAKKVVAGYSLLRLEQEVQDEWSDHLTLLNLRSWQMLGGRPVTEQIYVHSKLLVADDRVAILGSANINDRSLLGDRDSELAVVIRDDAQIDVKLNGIDSEPVSASVHKLRTGLWRKLFGMTDGATPATELSTVIGTPAAEGAWLAIQKTARVNAEAYSKAFPFLANVKGEPSSIWPVWNRDQLCLKFQMPFDERFWRKAEVRDPSFSWNAEQRAPESAPVGVKGFIVALPVTWTAGEDNISGMNLTLLAEHNQEPATLDQSEPSGNGLRYAKGNSLDQANEGESTSAV

SEQ ID NO: 257 - protein, 956 aa, Stenotrophomonas Sp.
MKHSKLSLALAGLIAVGAIAAADDVMAMSYHVQGDRIFLSGGVTYADVVSLPALLAKAQAEGRPIREVVLRTSNGGALIAGEWLQGVIRTSGLNTIVSGHCISSCSIMQSGGVERYLAGDLPIVDSVQIHAASNSGKVIYTPSPRMTQIYTGNYGGGIDAGLLHKAMYEVVQPNGLLVFRDPARTTGASVTFDPDGSGSKLESFPGQDIYSNRVITAKGYRDPGDTLNVTANVSGDINPGYLRTGRQLQTFVDDDFARWNTNWQSSYINLAQSIYNASSNGPQGIGANSVQDYQNDPTYKALLLSKLRLGDLDVSTLDNSMGVIRVTNGATWRTSATTGADFMLVDNGTIALEGGALRASEVRVMAAGMLVGNGDVAGTAMDLSALASGTRPSWREDGFNRLRVYGTLMPRGGDLVTHGYVNIMPGGKVLFDVTENGGAGSGRLRVGSFFDSKQTDGALVISKGAFLELNVAQGYYGQDFRRDLVQGPIYQGGFEEVVRLGDTGYSASITGGEVFRPRHNSLLSFNVKQAADGLWLTANPGFDQLGLFTNRTSGDGLGRALATASDRRDGGLKSLLGALQFADRDVIAQQAGALRGDAHATLRLADNALVGSIGNVVQQHQAAMRSGGDADGLASQAAQSVSAQPGMRHGSLFNQLAMHLVEPAAGGGEGSGPGRNHGLWARGFASHGRIDADGGVAGLSHNIGGIVVGADTRVADDRVTLGVSVAAADMSTKGRDGSDFSGDVRALDVGGYLDATYSRGYLSAAVRYTDLRHDTRRSVSGIDGLQQPLRAKYSNDAISARVEHAFSFTTGKGLVIQPLLPVVDYARTSATRFNEGQGAGALVGRSGSLESIRVGAGLQLFRTFEGNNGERITPRARVVWQKELGDSQARYSTGFAAAPDLVFGASSQAVGEQVLAWNLGVTSRASERLSIMADYVGERRDGQIQNGVMLGLGYKF

SEQ ID NO: 258 - protein, 1005 aa, Streptomyces Sp.
MSHHQFLRARRLLTSLLTGAVLTGGLLAAPGSSAATNAAAAIPTQEPGVTLRVFDVQTPLSKLCTLKPGQTPNHDALKSTVDWSTTDDFGGFSDRFVSEVTGYLVVPSDGTYGLRLTSDDGSRLSIDGDTVIDHDGLHGAEPKDTSVQLTAGSHPLRIDHFERDGGQELRLAWKPPGASDFTTVPREALSTDAGVVRVTAPGRKECEASGDTPGDGLPLTDVRPDLKLTDLRPDGFEPQVTGMDWLPDGRLAISTWGGSDNVAGEVYLLDNVTGDTSKDKVTVKKVASGLREPMGIKYVDGSLYVSQKHELTRLVDKNRDDVADEYRTVATWPYGKNFHEFAFGLLYRDGYFYVNLSVSINLGGATTVPQPAPGRGTTYKVSRKTGKISPIAGGLRTPNGIGWGPKGEIFATDNQGGWLPSSKLVHVKQGRFFNHYTEPSGAFDAATPTAPVLWLPQNEIANSPSTPLYVKKGQFKGQMLIGDVTYGGLQRAYLEKVKGQYQGAVFRYTQGLEAGVNRLSYGPDGSIYAGGLGADGNWGQEGKLKFGLQKLTPNGGNTFDVKTMRAVPGGFDLTYTQPVSAKTAEELAKHYKAEQWRYTPTSDYGGPKIAEEVLPVRSAELSKDKRTVKLRLDDLKPGRVVHLRSPRPFTSESGESLWNTEAWYTLNAMPGKQPPAATLYEAEEARLTGTAGIATDHPGYSGSGFVARYNTEGKVATTFDVQVKKSGTYDVNLRYSNGPNPFQGTKSLSLYANGKKLRQVKLASTSDWNSWSTQTEQVELRKGDNTISYRFEAGDTGHVNLDLITVRPKGASLALFDGTAASQSQWQHTDGRRLEWPLADEGSMEVCCGDIRTIDAYQDFKLHAEFRVPLLPDDVTGQNRGNSGIFIQDRYELQILDSYGDTTLDTNEAGAIYLKKAPDVNAAKAPETWQTYDIVFRAARYDDSGKKTADARLTVVWNGQKVHDDITLDSPTASGRAETPSTGAIRLQDHGNKVRFRNITLEPLT

SEQ ID NO: 259 - protein, 684 aa, Streptomyces Sp.
MITRTRLTALAATAALAATGGLITAAPASAAVTCTSPVWRVQYFGNSTFSGTPKLTACDSAISENYGYGDPTGVTLPKDNFSVRWSLTRDFGSGGPFRLSAATQDGMRVYVDGVRKIDLWKDVSTTARKGVDLTVPAGKHTIRVDHVAWTGLVYAGFTYAPRTAAAVDTVKPLAPTGLTAAYNRDTTKTTLRWAANKEMDLAGYRVYRRLSTTQWAKASGSSLLNSPSFVDATPATGQSFLYEVRAVDKAGRESAGSLDAIAATVDRTGPAAPTGLTVASDAWWATLAWQAGADAARYEVYAASAAAGPFELLGTTTTTSYRTDASVNTARYYRVRALDALGNPSAYAAVTGDGVDRTPPKSPTSLGSVVRVGDTEVYWKQPDGFYEDFDNGGTYRVYRSPGKTLDLAALTRVTCAEESDETSTGGICHDLDVPAGTYVSYAVVAVDPAGNESAPSAPLVVRTGDRVAPGPVAGVKATPRTDGVLMSWAASTEDDVERYVAWTGARQADGTVKWLSSTSCAEGTSDPLAVLCGDLPDGETYVYAVVAKDRWDNALPPNDSKVTVVEATEPDVRPSVTVTRDWDLGSMGYDTIIGGPDLDGPYINWRCDKTAECDTVTGYRVSRWNAATKAYEPLHAGLLAAETRAYTDTTAARGTTHFYMLEAVRADGSVVGTHVWSCVFQDRV

SEQ ID NO: 260 - protein, 99 aa, Streptomyces Sp.
MNTTSGAQTVMVTNSRTTTAPIAGVTTLTGNQSDNPTTVALSDTGTTQTDLAAGKPTSESSNTVTLTFPAATEHYFHALITADSGRPAGQVSEFHIWSS

SEQ ID NO: 261 - protein, 632 aa, Streptomyces Sp.
MGHSPRTGRARYAALTGIASLALAFAGLAGAAGPASAQDISGSQGSTTNEFNPWSPQNGHPYRHGAVPGMSQHENYKKWLAAHNQAAATGQQTLSYGGGVDGIGVQSGHSKVYLVFYGNQWGTQTTDAGGNAKFSNDSAGAAGATQQMFKGIGTNGETWSADLTQWCDGPNVATGAVSCPSNANFIPYQSGGVLSGVWYDNAAASPSQASGNQLAQEAVKAAGHFGNTTAAANRDAYYIVLSPHGTNPDDYQNPTTGYCAWHDWNGDTTLTGGAASSPYGDIAFSNQPYNIDAGSNCGVGFVNSPGTLDGWTMTLGHEWHEMMSDQNPAGGWTNHVSGSSYNGQENSDECAWIQPGSTGGAANISFGAFGSYAEQASWSNDTNSCAISHAILTHGNAVTVTSPGNQSGTVGTAVSLQINATDSATGQTLGYSATGLPAGLSINASTGLISGTPTAAGTSSVTVTATDTTGAAGSTTFTWTESTGGGGGNAITNGGLETGSLTGWTTVGSTSATAPAAHSGGYGAMVGSTGPTGDSSIAQTFTAPTGTSKLSFWYSNTCDDTVTYDWATATLKDNTTGTTTTVLAKTCTTTGTWTNKTATVTPGHSYTLTLSNHDDNYPGDPTYTYYDDVTVS

SEQ ID NO: 262 - protein, 829 aa, Streptomyces Sp.
MSPRHTRWARALTAATTLAALGAGTLAAAPAPADAPAAGQPAPATYTVAVGRTGSYAYPDDTQASPYTDKDGTFYFQQSHALYGAKDSRQWDFFTGRDFDSATRSSAISDAVNPADPSDRNDDTTARCNNSPTGRQSSYAPQGSHYAQRNYCDLAGVWVDPDSGAWYGLVHNEFTPQPFGDGLHYDAIDYAVSTDQGRTWTIRDHVITSPYSTARGDTAAFPQQTFSYGDGDQRLFADTASGYFYVFYGSRIVDKGGSWGAFQQHVARAPMSAKMAPGSWQKWYDGAWSQPGAGGLESDMVPADGANPTGYLPPAKEYNPANPGTVSRQIAAGTLAPSTPLFVMNISYDAYLGLYIGTPQAVDQSGNAPQQIYATKDLATQKWTLLGDTGGYHTASWYRWFLDSASLTGSTIVGKTFRSYCSFACAGSDGQYVELTVGSSAPAAPPVDLTRTYRIQNGNGRVLAQTAGGSAVTSTAKAAGSARESWRFLAEGDGSYRIVNAATGQLLGVDATSTAGRAWGAALTATGAVGGDATVGQQWFILPSKAGKGRFQLVNRYSGLVIGMSGTSGRLAETAPARSWSDTTGGTVGGGRTAAEQALALAPTGTAPEAVVLTAPGDRSGTVGKAASVQLGATDSAGKPLTFTATGLPAGLSVSPSGLITGTPTGPGVSKVTVTASSGTASGSADFTWTVEPDLGGNHTLTTGGKALDDADHSTAAGNPLITWTASGGSNQVWQFRPQPDGSYELVNGLSSMCADVSGGSTDAGAQVIQWPCSGGANQHWNVRLTADGSYSVTSAHSGLLLTTASGADGARVTQEPDTGSPLQRWSIS

SEQ ID NO: 263 - protein, 828 aa, Streptomyces Sp.
MPPRPRALPTGLALLAVLTAQALCAAPAPAAAGAPLVDGGSYQLGSALDGSCLGPQYAQPAPGTPVLGAACGRLLSQRWQLRRTGGDYLLVNAASGRCLTLGGPDLRPATADCGSAPEAERFTVSRAPQGTYTLTVRGTGACLTADPAPVNHHCDHRPAHRWTLTRTEPLVLADPGFEQSSGSGAPTTGAPTTGAPTTGAPAADSSSAADSSSATGGPSTAAGWTFTAHTGTATNNPHGGSRLAYLDAGPGYTVSQQVTAVTAGTYDLSAWIATGGAGGSLSVSVNGTVVRSLPLPEQSTYAKYTLPRVRVAAGDRLTLTIGSSPTGWVNVDDAAVAPSAPNDPVISSSDPEVVALFDWAKTKANSWVQQPGATGVLDQDENHPGGTGTTTYDASYWAGYPFRSAFYSRDFAHQLVGAHLLGLDAENKTMLRGFAASATDVNRLYPVWALNFDARSYAAIDYRGPDRFVRELPAPFELVQQAGEAFRWTGDRDYAEDPGLGRYVRNTLGPFIAARPGPVDNGGVPIPQATSRSIFAGTASYAENATRTYAEAGDAVGAQYQAYLAAATLAEARGDAASAAGYRKAADQLHTYVNTTWSVDGSRPGEVVHGYDTTGKPITGWGYEASVLMPVKRLLDPGPRRDGFLAAVDAADSGPERSANLEAYTYLPDAFFANHDGTTAWKWMRHIYESTGEPHVSGAMLNGDYPEVPFTLLAQTVQGLLGVTPDAAGHALTTAPQLPSSMGWLQVAGIPVGAGTVTVRHDGAQRSTVTNTGTERLTWEARFPGQHARVTVDGAPREARTTTVDGVTYTSTTVTLAPGRSATATVTD

SEQ ID NO: 264 - protein, 425 aa, Streptomyces Sp.
MRPTRSVSRTGRALMACTASAAVATVGLAVSPAAAVPAKSAATTQVEPGGACTAADLGTRHPYIKTTEVTPTITHFKGWYVTEGTTGSQTITTSTQTTISVSVGLNGTVQGSFAVETLGTVGASLGLNVQVTYSSTSSESNSVTWNFNRPGYYGVYKGTKKVTGTYGSLNCNRVQQGDASWALKWTEGAGSGSFTTYTALEEGAVRCEDEVPANSIMATAQGLLDCGSAAAKAEHPAGAVAPAAKQLRDRLVQRPALTVGTSAEQPKATGRSARSALNCGTDAYKIAVPGKPLSWGAPLLADDGVRLRPSTIFSAHLDNWRLCDVTENNGVLEASLWNWGNGRCAAIAEQNAATEGAVLMTAPCTEDDLQRFYIYRDVPGSSMIGVQNKYTGSMMGHDRYADGEFIRQYSSGRQDGTGTYTLTGV

SEQ ID NO: 265 - protein, 743 aa, Streptomyces Sp.
MKRLFSTARHIAVPRTRVRLVGATLMALLLVGIGLGVAPLLQGARAAGPATVPEQESIEAQIARAAASGKKQVDIEPGEYRRGSVLDLSGLDGFTINAKGVTVVQTRLVQAVRTGTSNNLTVTGLTINYDPLPFTQGRVIGLGKTSDGKPWMDVRIDAGYPRPDKIPSRVSVYDPALRLWRSQAYNIPVTWQDRTAGVVRSMGGAWAAGTGDIVAFAGEAESGPDIAIGVGGANNTFKDVTLHTAPGFGFQNRAGEGNTHLDNFRVVPGPPPPGGTEKPILTTTWDAMGFGWVKKGPTVENSTVVGAGDDSMSVQGFGTAKVLKADGDTLWAAFADGFRNALPGDRLQQWTDGPTASIRSIAPEKDPAIKALAGAKADFTYKLTLDRPSPWNAGTDITNLDRIGSGFVFRNNRIDSSGRGFLVKARDGVIENNWMRGVNSISVTPENTSDANANSGGNLVIRGNTFTGTLVSAPGGWDSCQVGAVSFDPGSASRPLYPDITIEDNVFQDIRGTGLNLGSAKNVTVRNNFFQRSHQATYPATKNRCGIPKSSVVYVSNSTGVTFEGNTIDRIGPYSVQQVTVDDRKPSGISGLPGGVKVLNPYLPVKAASTYTISNRDSRLLLAPAGGSTDAGAGVEQQSAADGSAQRWRLSPAGNNNTVRIQNAVSGLFLTGGSDSAVTQQPRSDDQSQRWRLLDTGNGTAKISNVATGKVLGATDSAPGAPAGQWPVSGALDQAWKFTDVSP

SEQ ID NO: 266 - protein, 329 aa, Streptomyces Sp.
MDYDPKKKGWYVYGHGQVSADGKQVVPDAKTRVWAFHGAMFNTGDILPWDMGWLQDVIDWLSGDPVELTTGMLTDSRTDLAVGGTLGSAEITRTYWQGDPEKRAFGIGRDLSYNAFLHSKKQWQEVDLYLPGGSKTHFTRTSTGTDWTNAVFEPLDSPSGFRGSKLVWKGYDGGWDLTFRDGSVWVFPQYAPLKEIRDRHGNAVKITRLDGKRGDITRISAPGGRWISLAYDAQHRVTGTKDNAGRTTAYTYDTAGRLDTVTDPAGKVSRYTYDGTTNRIRTAVDACGITYMSNTFDAAGGSRNRRSPRVRSTPSSTPRPARARSPRRP

SEQ ID NO: 267 - protein, 1316 aa, Streptomyces Sp.
MRLHGERFGVHLSTRWRSLTVGALVLALSAGLVSAEAAPSPTSGASSSTPSSGPPSAPPSAPPQAPPSEAKRAAERAAEPAGPEQTPAAAAAAAAPAVSDAVYAYDAAGRLVGSTDPAGETARYRYDEAGNRLGIDRFASADLSVLSLVPTRAAVGATVTLSGTGFSTTPSSNAVSFGGQTAEVVSASATRLKVKVPAAAVAGKVSVTTGGGTAQSPESFTLAAPAPSVTKVDPTSGYAGTAVVLSGAGFAAATADNVVRFGGGVVAEIVERTDTALKVLVPAGAATGPVEVATPDGRTTSAAAFRLVAGDGGGEIETSVETSVTDETPPTVSVTTPGNQAQVVFDANAGDDISIGFTESTFNQTVTVRLLDPQGKRLESAAYTGTAGDWEMTDVPVSGQYSVIVDPGTGNIGSVKVTVSNPRISALDLAGPAVDAQFTRPGQDHLLTFAALLGDSLSLGIDATGLAKSTYARLYGPDGAEIDKVYVTGTRIGGLDVDALTQSGTYTLQLDPDAAALGTVKVTGSHYADAGTLTATGPALDVSLIRQGQQGRAQFSAQAGQRVSLGGSATGFGNFTRVEIHQPDGALLDYFLVPDADAGQWDSATLTTSGTYTVVVKPGSPLATGKMTLTLSRPLALAALTTTASASAVNITRPGQNAESSFQAQAGADLSLGFTANTFPQYIDVTVTAPSGAKVVDGVNVTAGAATTIPLPVLTEAGTYQVVLDPNKGAVGATSLTLSAVARATLTADGAQQPTTVARAGQRVRATFTAPDTAALGLAVTANTIAESTEIRLIGPDGGAGALAGRVASKASDTFYLTGLTSGTAYQLVFEPAKATTGAMTLWLSKPVKAGTLSTTAPTLTGEITRPGAQLEFGVNAVTGYGAAVVFSGTTLTETSALIHQTPGGVEDNVGSLSKATLDADLRAPLAVGGHRVFVRPNGSATGKTTATLVPNVTGGALATTGTKKSVAIATAGQNAHYTFTGTAGQKLTLGLDTPPGAWSLSVHGPDGKWLVDGRNMSATTVSYALPALPANGTYTLSVDPNSLKTGTWNLGLTAAATLRAATAADTADGPDTAEGADKAAGADEPATPKPPAAGVTPTGADAWQPDKGNLSGHDWLTRRGDAPKAPPTLRAPPKTTALTGHVLKLDGKPLAGVTVSAGANTARTDAEGRFLLAGISPEATTLVVDGASANTKQRQYGRFDIRIRPKADTSVDLGFPVWMTPLDMKNTVRFAAPAKTDVVLKTPKIPGLEVRIPKGSVVRDEKGRPVTELGITAIPIDRPPFPLPENGVVPVFFTVQPGGTYVFPEGADRLPELHA

SEQ ID NO: 268 - protein, 733 aa, Streptomyces Sp.
MDSVGRVVRRGTTLGALSVVLGVLTTGTATAGTATAETATAGQDSGALSARVAPTQEDIQLGSWMSQLGSTIGDRPLNQIVMPGSHDAGSAGITKNSGMCDAGDTVDTARKWPELASSMSRTQSGSLVEQLEAGSRYLDLRLCKQGDKWYSYHGGPLGRQFFDSLGGNQGIVPGEARELADWINRHPKEIVILRVKTTGPAATLKEDSRAAIARLGGLVGGGGLDNPAIADGSLKPTSTYNEFMAAGKHVVVVDDTDSTTYPWAWQQPNVQDYRGSYVGVSSKWDDILKAALDPALEQKTYDAVLRRGDEVLGKTPEPGSEKKLFVQQAMIDPSNSIPSAAVIQILEKLKLVSEWKADNFLISMENELNRQLLAKLRTSWNNTNVTDNMNIVMTDDVNQNRNGVAAGELQREIISKNLPQRITSHTFYNSTRKADGTWTGPSALSGAGTAFRYVGDRQAVGATRDGGVQVLGVGADGNIWHNLRRPDGSWQGWNALLAADNKNVGFAAKDIALTTMPNGDAQVVAVGKDGYAYHNIRSADGGWQGWASMPGHDAGLLKATKVAAAGMPDGSTQVLVFGGDGRMRLGTRAADGAWSSWKTVAGVNAPDFAGSALSIAALPNGDSQIAAIGNDGNVWHTTHRADGSWSDWGLPAGVSGGAMEASAVSLAGMPGGSVQVAAVGRDGNVYHGVRSSGGDWTPFQRVSGIKGAGAFAGDQVGIAGLPNGSSQLILTTR

SEQ ID NO: 269 - protein, 1572 aa, Streptomyces Sp.
MPRHKALLIGASEYDDETIRSLPFVRDDLQRLEGVLSDRGFRPVEIAESQRGITPNAVNRHVLRFLREAGRGDTLFIMLSGHGVHFDGRDYLVPEDAYYESEPFAESCVEIGWQKELEDSPAGQVVFLIDACREGSARRTKSPTRMPGWERPKIAATLRRKIAYVYACSKAQYALYVDESEAVLPQHADAAGTQPKDSFSLFSRAVSDVVSAVPHTLHMGEFLDEVQRRLTALHTAYGKTQPVQRVRAETDIPWQEFTVLPGPARDAAEHPWVRSTATHPAWERTTPGAAREALKDVCATLAARLAEGYETAAATLRDDPWHDAELAKRAQDRLGFLTGRLAAGAELSPTEGALTVLLPLLGQAFWTHEAAQRAPVVTAGPADQPTPERDRFGKFAQGFPRLQRRLRTLEQRGVSDGSAERIRWWLFHRWLIRQPELYASQTLKTLLGPPPGGTQCPEWVTEALSGERFMRFLQELRAAPFAVPRDTPGRPGDQRDGDCDVIAASTRDEHEVRESLVASLAKAAQAFAVDPVDLPEILVEHIGISDSVDLDELLTTIRGSDWRTSGLGRSLNAVCGHPAVQIALREHARRVDGLLRDINRTSALAPLRSLPPYADADRVRLGGNTPTHLADGIRFQLAEDRVQELLMGEELYGERELAIRELYQNALDAVRYRDRRTEYLRRTGEMPTQWDGLIEFVQKADAQGRPYLECRDNGVGMGLDELRNVFSQGGARFVDLPEYIEEQTAWAELGEPRIELHPNSRFGIGVLSYFMLADEIEVTTCRMARDGRPGNKYQVKIAGPGNLFRVDDLGPGTDSGTTVRLLLTDHKERVSCVDTLQRVLWLAPYRTSAEHGSRRHEWEPGQLSLSGPELVWADDSEMFRRTGACYPSGNPDVWWVDGTGRFLSDGLLASTNSATTGSSARERYGAVVNLREQHQPELSVDRKTIRSNDEDHVNAVLSEALPSLFSTARPLLVPDWLVEASRSSVGFGDEVAERARTSRVPWPAGDTERPFDALGFFRPDQTLLPLVTGHYPAVREEHGPSYLRLVPTPVLRWRLLTLYRAGLGDPLTEAAQASPPLPCARPSDHQLLSAQGSYTTLNWTQRYKDWLTGPENSTFYLLKSPSRTLVDSGILSAHSVEVWRDPEQVVTLDEIFGLVGLTELTAEAVAERLTALGYSVVPPTGCERVRREDLPLLRPLGSVTDGWLEPGSDLSVAQLCLSAARAECSTREAADRLRDLGFAVPTEYPNSDAWTAEDREVLRGLWDLHADPVPPDRAREISYAQLISVARASGATTQAVVALLRDTGFSVPSPGTPGLMFRDEEWALLVYNGISLNVDRPVPLPHVVGVAYRTGQTPEAVAVRLRALGFEVPELPADGPLPSKQDINFLYARYESSSGKAWPRPDRPMGLGAIAERAGRSTLSMTETAARLNGLGYRCAPAQWLLDRFQEHDVEALRWTLPDDDHQTVISPPQLYAVAEHLGRPAEDVAQSLTDFGYDVAEIPGTRIQERKAEADLIDVLSSGEDPVIDIAYEAELSLPTLATVAMRLGLPFRTVALKATALGMRHEAETWFAAG

SEQ ID NO: 270 - protein, 457 aa, Streptomyces Sp.
MRALPAPPRRIALLALSALLLLVPALWPRLTQPAAADTGSFSLLYDPGPAHDCYALVVEDPPDKNTTPDPGRTSSAGCDAFAGTEEFTRKSPERPTWDIGTYGWNTSNWGTSPGYSFTTQTAAKTVTMRNDASGVCGLHETNVSYTYPDSQLKPGPDRAYRTAADGRINVSYRAKIQQTEPFTCGEKRALLTTDLIFEDSEHGSAHPDVISVIHYDPGTFKAPDSNGVVWYTRDDTTMTCPDGCRVMVRSPDLMKDATWASIDDDFSQLFDKYVDYVNPEHLPKSDFVLRGIQIVSSNTGSSTTASVSDVDARMTPNAPVHAPLTYGLKGSDGQSLCLDDYNNATTPPAVADIWDCNGGDAQDWTIGQDDTLQVHGLCLGVSGDGTADHAPVGLDRCDGGAHQKWVLGRYGQIYNPVSGRCLEVANASDTRGDKNLELFDCWGGAQQKWWTPAGDYR

SEQ ID NO: 271 - protein, 2608 aa, Streptomyces Sp.
MRWFATVRRRIWGRGLTVATATAAVYTLIVSAAVAQGVPEYHYDGKLWSAGPTYKTPSVGGHPLAGRTPATPKTTKPLRTYRPARPAWPSAGTSTIALTQSAKSSATTSTPQHQTADGPATSPVRAGKLPVWVAPAKQAAKKRGAAPSTPAAVRVQLAGHAQAQAAGVDGMLLGLARADGAASSGRVAVTLDYSALDKAYGGGFASRLHLVSVPGCILTAPQKPSCRVRTPLASTNNPVARKLTATLNLPRPTTSGAAGASAHAGGTAGSASVAPMTAVEAISGASGSQGDYTATSLNPSGSWSANGTGAFTYSYPVAVPPSLGGAAPSVAFSYDSQSEDGETSARNSQSSWIGDGWSYSPGFIERSYKPCKQDGISDSADLCWGGWLATLSLGGHSGTLVRDESGNPDTPTANQTWHLQGDDGTKIEELGGADNGLWNGEYFKVTTTDGTAYYFGLNHAPGTTSDAATNSAWGEPVYSPKSGDPCYDSGQGKDSQCTMGYRFNLDFVVDPHTNVQRYTYATETNHYDRGGGQVAASGGSGTLTKYVRGGYLTEIDYGYQLTDETAGSKPGARVLFKTAQRCQTSSTFTDCSYANLNDKTATNWPDVPYDLNCASTDTTSGTGSNVCLTTAPSFWSTDRLDSVVTQVNVGGTLTDVDTYQLTQTYSDAGGTVDPVTGQSGKDAADEGELQSVMWLSSIQHTGDDTTGGGSTSPITLPKVTFLGTEIDNRIDGGNEPALFHPRMSSVTTETGESIAVTYSDPDCSRLNHTMPSAPDADTMSCYNVYWTIPGGVTPVSDWFNKTRVKTVTVSDGTGTGSPAQVSNYTYSGPAWHRDDSELTDDTYRTWDQFRGYRTVTVTTGAGSDPITQKTTTYLQGMDGDVRADGSKRSVSVTDSVGDTVTDSDWLSGTPLEADTYTQAGGSVVAKQIDLPQTFTTTATHNAGSSLPAVVARMIKTSQQRTYGLLADGSWREAETDTSYNGDALPTTVDAKGDVSVASQEKCATTSYATPPSGNPMMLSYPDEVLTVAGPCSTTPGTSTTVSDKRMFYDGDGTVTNVGTFGHLGTTGDLTATQIITGYSSGAPTYRTTQATAYDIYGRAIQVQDADSNTTKTAFTPTTGQLPTQLVTTNPRTWTTTSVMDPLRGLTMTSTDPNGRTTTIDYDALGRRTAMWLPGRPTSQSASRTFTYAVNDTAPTTITTNTLRDDSNYSTAIDIYDGMLQLRQTQSTTANNQAGRLISDTFYDSHGWARKTNSTYYESSTSPTNTMWVADDNQVPSQQVTVHDGLGRTTATQLWSKGAQRWQSTTAYPGVDRTDTTPPSGGTATSSFTNALGQTTATWMYDDTATPTGKASDAVVTGYTYTPAGQVATMSDNAGNKWTYSYDLLGQETKQTDPDTGTTTFDKYDDLGNLLQATDARGQILSYAYDTLDRKTAEYSGAWSATPDPSNELASFNYDTLAKGYPTSATRYVGGAGGDAYTQAVTGYTTDYQPTGGSTTIPTSTGFPSNSTGTNSNTYTVKYHYTPIMGLLSEADYGADGGLPAETLGYGYDLQGLLDGFGGNGTYLDTTDYTPLGQVKDTRWGLYGEQVEPTFSYDDTTGRVTQSQVNLQTSATSALDVTDYRYNQAGDVTAVSDTQSGGTTDTQCFTYDHLNRLTTAWTDTAGLTSAGVGSTGACTTSTPLASTTGGPAPYWQSYTYNALGDRTQQVQHDTAGNTANDITQTATYPGSGTTPATLANAATKITTTGPAGTATMTPAYNGAGDTTGRTVTTAGPLVSGQTRSGTKLCADDSSSGTTDGNKIDLYTCNGSTAQQWTIDTDGTVRVLGKCLDASGGGTTNGTKIDLYTCNKSAEQQWKAGANGSLVNPASGKCLDDPSASTTNGTQLQIWTCNGTPAQRWTNATMGTVLPGATQALGYDAEGRTASVTTPSGGKNQTTSYLYDAGGSLLLQTTPTSKILYLFGGAEQLTLSTSGGTVTGQRYYPGPDGITEVRSSAGTLTYEVSNAQGTATESLAASNLAVTRRYFDPYGNPRGPQPTTWTDNHGYLGKPADPTTGLNLLGARDYDPVQGRFLTADPLMEAGDPNQMSGYSYAADNPSTGSDPTGLHLACGDGDDPPCPSGGGASIGGMGGSSTTGGGGGGGGGTTTSSGGTAAAPSAGPACNVASKFGCDVVDAQQMADNGPPTSGTLRDFIAGALDEFVHQLEQLNPGWAMGNVPHDVANGMAPGIAGPPRYVEPRHVVAHTVHAHTNTDAYKGGEATTVLLEFAASGGDDAPEAAVSAVADAGDAQDGLAAAAEVKNVVSQTTGEATATAATPSEPATGASGTGEGPCSFSPSTRVLLAQGKTKAIAAVRPGDKVEAADPDTGRHRGPRTVQHVWINHDHDLLDVTIRTKGDHTATLHTTANHPFWDDTTHRWVPAGKLHHGDALKTSSNGHAYIVASHATPGTAKRWNLAVQQLHTYYVVAGGVSILVHNSNGPDSCPVLGAARAAADTASAITPGKARPAVAEALQLPGGQIYSSPSIRGVAPELHSDVQAILDDIPEGERGVGHGRCGLAVCVSDALSDGFNPTGSRAAAVIVRSSTDNPMHGMPVGPCDSCVALEDAFDIRFEGIG

SEQ ID NO: 272 - protein, 1444 aa, Streptomyces Sp.
MGGRTRLSCRRWRTAPHHLAVMAVLCTLVLGAAPTAAADSSGPVPGNPTQSALLQAQATDKPVPVDSLTSQTTTTTANPDGSLTTTEYVQPVRVMKDDAWTAVDASLVKNADGSLSPAATPNDATLSGGGSGPLVSLTDPAGRGLSLSVPFTLPAPTVSGNTATYASVLPGVDLEATISDQGGFSDVLIVHDATAAANPDLRRLTLAATTQGLTLAGSADGGMTASAADGTTAYTASAPIMWDSTTTTAGPQPASMHLDDATSTTPPPPDGPAPGADVAPVTMTTTSNSLTLTPDNSMLTGTGTTWPVYIDPGVLPSETTNHYFEAQHGCNSSSASSHEYDYPQRFGEGVGYQRYASSNGDCIGAERAFYQLDTSNLNSSMDIIKSELHLTETYAEAYGCTHTAPLTLKWTGGISSGMYWDTQPSVVSTIATKNPSSAYNGAYASQPTSCGDQDVVFTVTDKIAKIASDNDSTWTVGLYGDEDSSSSNIDFMRYSTNPYIQTTYDIPPDTPTSETTTPDAHNPSGANCGSSTRGWIGQTTLNGNTSDITLNAKLTSNVKGENVKADYTVWDDQTANSSGNAATVATPSSSYVASGTTVHISIGTTVEDGHQYGWQVRAYDGTLYSSWNSPCGFKVDLTPPSQPSVTAPSAVFPPAGSNQAPTGYAGQTSTITVTSSDPTPTGCTRGTCLSSDVWRFCYALDVQPAVNCPDYVTATTNSSGTPSASIPLDPTTWGTHTLYVEAQDHAGNTQALPTTYTFYAPWNPATKVAAGDLSGDGVPDLLGTTKNGDLTLLPGNTDPGNSPTLASTASQSPDGKTSWNDYLITHRGSIKQDGLDDLFAKNSHNLYVYKNDGAISSGTPGHFTNTADVYGPLDKPQCLPTADNATNCVTYNAADWSSVTQMIAPGDVYGTGYPDLITIENKQLWLYKGSAQDSSYFGPATGGTTSTTPVLLGTGDWSHFTLIAPGTVNSTPALWARDNNTGTLYTFPLTADSNGLPPLLTAPTSSALTSGLTAADGTSLCADDSHAATQNGNKIQIWGCNNTHAQSWTPAADGSIRVLGKCLDVTHGGTTDGTLIDLWTCNGTGAQQWKLGSNHSLLNPGSGKCLDDPNSSTTNGTQLQLHTCNGTGAQSWTSSTPSNWASDAATALPVTLAASDYPTVASPGNLNGTTAGYPALYATTSAGELIEYPGAAPDTNGTATFGSPVTVGYYNTANAAWPLNDDTDRTAADSIGTNDATLNGAAAWTSDSTRGTVLSLDGTTGYAQSTSSALPTGTHTDPTDGTTTDNNSFSVSAWVKLNSLTNNSTFVSQSDSTGNANAYQLYYSSGSQKWAFDRHDDDTTGTNFTAVYGAKATTGTWTHLVGVYDGPTNTLNLYVNGTLTATKTFAGTPWNATGPVQIGRRLYQGTYGEYANADISDIQLYNTALPPSEISALDYDQTPYTQLS

SEQ ID NO: 273 - protein, 688 aa, Streptomyces Sp.
MPPPTVRRSRRRLPVAVLAAALGAVTLGAPSPASASPSDAAEEAGHLVGRGIADVTGEAAETGMMGYSSFDQKTSGIHQRQRSRAFVVVDRSSGKRVVYVNADLGMIFQSVRQGVMARLKERYGSLYGEENVLLSATHTHSGPGGYSHNVAYNLSVLGFQKETYRAIVDGITESVAKAHDDLKPGTMSLGTGTLTNASVNRSREAFDRNPAADRSAFPDGIDPAMTVLRFRQGGKDAGAISWFATHNTSITNKNTLISPDNKGYASYVWEHDHEGVRYLDDTPGFVAAFPNTNAGDMSPNLNLKPGSGPTEDEFENARVIGERQLDKAREVYDDARPVTGGVDSRIAYVDMENVTVRPEYTPDGKEHRTCPAVVGASTLAGSVEDGPAIPLFEEGMRTPVATVLEALRVDTPSWLATCQYPKASLIPTGLLSNVHPVTPKRLPLQIMKIGELHLVAAPGEFTITSGLRVRRTVAERLGVPLDRVLLQGYANAYSQYVTTPEEYDTQNYEGGSTLYGRYTLPAYQQEYARIADSLRAGTALERGTMPADESGRQFTFQTGVVYDNPPSGKAFGAVLKAPESSYARGSTATAEFATGHPKNNVRRGSTFLEVQRLENGTWQRVLDDGDGETVYRWTRINGLTGTSKATITWRIAADTAPGTYRIVHHGDAKNLLGRITPFSGATGAFTVK

SEQ ID NO: 274 - protein, 806 aa, Bacillus Sp.
MVHFKNCPDPSLNANSQSHPEFSSELEHIKARMQNFIKHSVTDQNIEVTDARVTAEGEITSLLKERLDKEYFKLLSKITREVNVEDFGAVPDGRDNTEAFRKAIGNGRVKVNVPAGEYLVQGIKLPSWTTIVGQGKGITVIKLHEDTPAHEWVITNDDYQNGNRNIFVQGMSLDWNPSRQCGVRNPGGQFSSCLTFAKVEYGWIKDVEAINAGLHGIDITSPTYDHLPDTDWTKDGSRYIWIDNCVTYGSGDDGITTHYSEYIFISNCHSGNPRGTEFVEGVSNSNGIEVDDGSRHVWLLNNFTSGNIRGVEVKAHELWPASQNVHIIGHVSYRDVRAFDLRHIGHHQITDPESTTAYDVTLIDCSAIEPVFNSLYDAVTPRALVISAYKNVNVSGFTAIGDPDYDYKGNPVVALQYRSQNITINGIKIRGFKKAGVDINLSGGSNKTDYIKISNFDIYKSAPKGISIGGGLYNVNILNGTMITDNGTVGIQSPNNQATILGVQSEGYSVAASIKGQTYQQIPINLKGGIQLATTSGFAVNQTSAVIAGTGDITARGERNAVISSSGGSSTEGSRALIASSNNAHIKGNHVSRTILSSENIILEEPYTVAGGHQSMKWLLDSVRGNGTFAGAISSSLGGYGEYFESSTGQLIHTGTIVTLRGEKIAPADVGDYMLGVISETSAFISGASSFVWQGRYLTNEFGGFIYEVVTDEESGELIRVPKQNPDYDTALEANYHSRAARDEWHVVGLVGKHYVRIDETVSQGNYLTAHNGIGTKAAEGSWKVMKITSAYTSEKGYGIALTVIK

SEQ ID NO: 275 - protein, 266 aa, Streptomyces Sp.
MINIRIRTAAGAVALACAVVLTPEIPAAAAPAAATEPAPFSCLDPSGEALWSGPQCDGVIVRELGTEAVAILLDGRRIDFADEAELRADDCAVRPAVTLPASTFENLPKGPDPLYAAVDRRVDVPRIIPEPQWRKNCHPLFRSDGRDPSVIFEEGFGPKDTVNGQYDITSYVLQNQPSPFVSTTYDPELYKKWKKVPWDYFIDAPGGIDVNATIGDQHQYADQVEVAFPGGVDRHFIRRACPVDRATASLVEAGCVDNPNYQPWLH

SEQ ID NO: 276 - protein, 1071 aa, Stenotrophomonas Sp.
MTHVATRNTLQSRLLLLPLLSLPMTLATAANTLETVQVTATLPVGGGGAGGFGFGGGSGVHLSESQMDNGGGGGAIPTETAKEQPTDDKEKDCNGRKGNPVVLYSGNKVEPELDFASQGEMGLFLQRNYNHYWSATGLFGNHWLSNFDYSLAFTDANQLAWVQRPDGRRIKYLKDPASGRWYEDKAQPIAYLAANGDGTFTLRNENNGTEIYNAEGYITRLSNEQGVSWTFSYTDRYLQKVTHSSGRSISFGWTNGQVSQVTDPAGNIYRYTYTPNVFGNGRGRLASTTLPGAPATTISYHYEDGRFPGALTGKSFDGVRYSTFAYDAERRAISTEHNGGIERFRFSYAVRSTEPVLPPPAPARPGGVRADEERGWCEQRPGGSRICYQPRSLPVDSLPMESALGMTAAAAPSLTRPVDIDVTVINPLGRSTTYTFKDGKIVSTKGDPSPNCPASYKEQSYDANGYPDLVHDFQDNLTNFDYSAQGYLLKRVEAVGSTAERTTLQEWDTARNRLLKTTVVGDLEVAYTYDDRGNVASVTERNLTARGVPSQTRVTRTTYSYHANGLKASIKIDGPLPQDDVTSTFNNQGDLTSTTNALGHTISYSNFNGLGLPGRIVNANGGVRELTYDGRGRVVSDRTSSGTGWATTAIGYTSAGDIASLTQPDGVTVRYGYDAGRRLTHEVRSLGDGTWAWTRHSYNNASNRTRTEVSQTDYPIDTAVKGMIDEITHDGQWNWFARGWACSTGSAGSIQVDGYAEGNVYLGSTQANLASEPGVAAACQASGNGYRYQLPISLAQRQQLGGRKFSIYGVSPKGAQHNQALGNSGNFAIPTATIIGDVAGVTNDANWNFSVQGWACSVGVNAATTVHIYAGGPAGAGTYLGSVTGTLVPNDDVKAACQSQGAYWFGFTLDSNMRNAHGGKPIYVHGISPSGQAHLLLNRSGTFTVPAIVRNAEVVGASAYPYQIFNGGSSTLIFEFRNTSNVVWNPGDTYLAFGLNQPNENIALSAPVPPGGVARFSRSVGPNNPGSGNRTFSYVARMASGGVAWGAEAKVFLSVENNKGSCGRVVCERPR

SEQ ID NO: 277 - protein, 2591 aa, Streptomyces Sp.
MAAAALIAAVVQIPAIAVAAGNEIKLPPVQHIEPVPLTRVVAEQPAAKAAQPKTAPPVAAWPKPGQADVDLPPSRAQNPSPQAKAPGLPLTITSTGANPAAGEQAKVRVALSDRAAAAKVGLDGVLVNLEPVAGSTTPDKARVQLDYKAFRESFGADWGSRLTFVQLPECALTTPDQPQCRTATPVAASNDTKAGTLTADVAVAAPTGQTSDGPNKVSLAQAAGTSVAGATVLAATAEASGPDGNYKATSLSPSSTWSVSGNTGSFNWSYPIPVPPVPGDLAPQVALGYTSAAIDGRTASTNNQSSWIGDGWDYNPGFIERAYTGCAGDKGSGSNAPETGGDLCWKSDNATVSLNGSSSALVRDDASGTWKLSNDDGSRVEKLNGNATDTANGDTDNEYWKVTTTDGTQYFFGKNRLPGWSAGKPETGAALTVPVFGNQPGEPGYAPAFKDSSRDRAWRWQLDYVVDPHGNAIAYFYDQEKNAYAKNIGAATGTSKADALYTRAATLNRIEYGHRAGQVYNASPAGKVTFSTSDRCVETDCSFTEANAAYWYDTPVDQSCDKGQDCRNGAPTFWSKRRLTGISTQALQSNGSYKDVDAWSLDQDFPATGSSGGRALWLKTITRTAKAGSAQLTLQPVTFGGDLRPNRVDSAEGRSPMNRYRVNRITSETGSNTDVKYTDIDCVAGALPAPDSNTRRCYPSWWTPEGGAEPVFDWFHKYLVEKVTEHDLVAGSGSPDKVTAYEYLDGAAWRRDNSEFTPDKERTWNDFRGYQRVRTRIGDSGKSLTETVYFRGMDGDTLANGQPRPVSPLQGVKDSNELTGFARESIVYDKDDKDGGKPVTSTVNNPWLRSTASRAVKALPSKDNKTATPPAEKDRPEVAVLPPVTATMVRTESVTTNAFQPDGSTARTLRESRTFDSYGQTTAVSDEGDTNVTGDEQCTRTTYVTPDTTNWLISYPRSVQTTSTLCSTNATPATVTSEARTAYDSKPLGSAPEPGKGYATTTEALDRYDGTTPHYLTVSTTAYDQYGRATSVKDVNSAETTTSYTPASGSQATVVQSTNPKKFTTTTTNDGLRALPVKVVDANNRTTHVDYDALGRTTAVWNPGRDKNASPNVTYAYTVEPGKQPAVTTRTLLENGDYRTSIALYDGLLRPRQVQDEAYGGSEAHNGGRNITDSFYDSHGRIYRTNAAYHSTGTPEAALWIGLDNKVPSQTETEFDGLDRPTASIFKSQNKEQWRTTTRYGVNWGATTPPGGGTPTLTITDAHGRTSEVRQYKSGSPDFGADASAYETLKYTYNPAGKLTRFTDAAGNAWTWEYDLLGRQTKAVDPDRGTTTSSYNADGTLATVTDARGRTLAYTYDVLGRKTGMFDGSTTGPKLAEWAFDTLPGSNGLATGSTRWENGKAYTSGITGFDGAARPLGSTVTIPDSEGALAGTYTTAQTYTPNTGLGDTTTYPAGGGLRQESIHRDYTLLGLPTFVTDGGNQVYSQGNTYNEYGQITQSSIGRFGSGAYQTYVYEEHTKRLAQARTDGYSKPQTLNNKTYTYNQIGNITQVRDARGNPAVTDTQCYTYDFAQRLSNAWSATDNCVAQPTPTTDPYVGGVDPYWTNYTYDAAGNRTQATNRTSGAAPGPLMDTTKVTSVAIAGDGQTSAVAIADGQVYLSQQRADGTWANFENLHRTQAGPLPAPVDYVAAAWADNTLQIMAVAGGRIWHTLRGADGKWGGWGDVTSVVGSIANPSQLSLSATASGLEVLALSDGVLKHTLRKPDGNWSTWGSVYSETGSLTGATRVTSAATSTGLEVIVIAGDKLWHTVRYPNASWSKWGDVYSVNGALTSPTNLAATATAAGLETAVIAGGNIWHTLRKPDGNWTSWGNVSLVVGPLSQPTSAAVVSSLGDLKLITVAGGTLNYTKRSSSTGNWAPWSSLTQTPENPQTSQNQRTSTYPAPGGTRPHALSRVDITGTGARTDTFTYDDAGNTVRRVTADGDQALEWDTEGHLTKSTTAGKSTTFLYDANGNRLLRREPDAVTLYLDGQELKLDKTANKVIGTRYITVAGATIVKASDGTLNYLINDHQGTAQLTISADNLYTRGDTTPFGTPRGRKPASWPTERGFVGGTNDATTGLTHLGARDYDAANGRFISVDPVLDLTDPQQINGYAYSNNNPVNLTDPSGQRPEGICGGFGTCYDSKGNINTETFKREDDGTYTENYWNHWSGSKENPNVVSPHMHIIYRGGSLKQNVHGMFDSIQYIPGVSAIGAVGSAVMDAADGHYMSAAQNLAGAIPGERLFAMAGKAGKAAMAADRAEDVGNATADALSILSCDGAQAGAMHSFPPGTRVLLADGTTQTIESLQLGDQVQATDPTTGETESKSVIRTIRTPDDEHFTDLQLQVNASDGEPGAVETLTSTQHHPFWDETTHQWTNAAELTPGDTVRTVDGRTPTVLAVRNYDTAPQVAYDLTIADLHTYYVLAGATPVLVHNCGEPRFSVGSDGVVEDLANPLPVRGGYVPVPKLDGGTVPGVGNKIWGNSDPEHLIGTRSPEALRGIASKADAGKLQDFYAGAANAGKGGASGRGSQNSRNPVDTARNRVTLLQEIIDAWS

SEQ ID NO: 278 - protein, 726 aa, Streptomyces Sp.
MGHRSTELRRRKRRRLTRRSALVAAAVAAGLLAGTLGIRTALEPAALNGAVTAAADGVDGSGTQAGLVGYDGAPGETGTAEGATQVPAPKRDQKAAPLKAIPKDEPERGLVYAGLSLPGSDRCGGTLEVTGSTQCSHGPDVPPKGVDIRQDVPPVAAPVARTPALTPAAGAQAPAAADLLKGSAPVLDATQKALLGGAGTAADAARAGADAPAGSKLVCEGDGSSGNRVQVVYVHSPGNDRFAQYLASFKKWAADVDVIYNASAAETGGERHVRFVTESDCSASVLNVQISDAEIQDFNASNRALAAQGFNRKDRKYMMFTDAKVYCGIGTFAGDERPGQDNLSNFGPSYGRTDSGCWSGSTAAHELGHNLGAVNNSVPNSSKAGHCVDEWDVMCYSDAPDYPQMRTVCPDRAHDDRLDCNHDDYYNTSPSPGSYLTTHWNVANNRFLVAGGGSGPDPTPTPTPTGTPTRTPSPSPTPTGSTTPTPTGSPSPTATPTATPTATPTPTATPTAGNTGPAVAVSQVTQNSAVLSWTAAPAAAGYDVLLNGQAIGTVRSTVVGVVRLAPGTSYTVAVAVRDAAGAVGKPGRTATFRTVTDTGRPQPGTRYTMVNGLTGQAADLWGSSMNDGTVAIAYQRTGYANQKWQFEDAGNGAVRIKSARSGKCLQLGGAPVAGQYVAQQPCSDTAAQKWQLNAVEGGFTVTADGGSLVLGLSTRWYYGGWLLELQ

SEQ ID NO: 279 - protein, 317 aa, Streptomyces Sp.
MSTAETDLVETPAADPRVEVLPARDVPLGGPRAMTVRRTLPQRSRTMIGAWCFVDHYGPDDVAGTGGMDVAPHPHTGLQTVSWLFTGEIEHRDSLGVHAYVRPGEVNLMTSGRGIAHSEVSTPATTVLHGVQLWIALPEEHRHTGRDFRHHAPAPVTLDGGEARVFLGTLAGDTSPVPTFTPLLGAELTLRPHAVVTLDVDPAFEHGLLVDNGEVRLLDTPLRPAELGYVAPGRRTLTLTNTGATDARLVLLGGTPFEERIVMWWNFIGRSHEDIARAREEWQAASDRFGTVQGYPGDRLPAPELPGVPLKPRGNVR

SEQ ID NO: 280 - protein, 2489 aa, Streptomyces Sp.
MYPFDTGAPPGAKKRRSGAITRPLLLRAAPIAATALIAAVVQVPVIAAAADGEFKLPSVQHIESVPLSRVTGDRPDTGAAQPPTAPPASAWPKPGKTEIDLPAVSAQQPSSQAKAPGLPLTVSSVGPTPAAGEPSKVRVGLSDRAAAATVGLDGLLVNLEPVAGSAAPDKARVQLDYKAFRESFGADWGSRLTFVQLPACALTTPDQPQCRSATPLAASNDTKAGTLTAEVAVSAPAGQVSADGQASSGGTVKASFTQASEASAAAATVLAATAGASGPEGDYKATSLSPSSTWSVTGNTGSFTWSYPIQVPPVPGGMAPKIALGYTSAAIDGRTASTNNQSSWIGDGWDYNPGFIERNYTPCVGDTGPGSNAPATSGDLCWKSDNATISLNGNASALVRDDASGTWKLSNDDGSRVEKLNGNTTDTANGDTDNEYWKVTTTDGTQYLFGKNRLPGWTTGKPETGSALTVPVFGNQPGEPGYAPAFKDSSRDRAWRWQLDYVVDPHGNAIAYFYGQEKNAYAKNIGAATGTPKADALYTRAVTLNRIEYGHRAGQVYNTPPAGKVTFSTADRCVAADCSFTKANAGNWYDTPVDQSCDKDQDCRNGAPTFWSKKRVTGISTQALQSNGSYRDIDAWSLDQDFPATGDSGGRALWLKTITRTAKAGAAAQTLQPVTFGGDLRPNRVDSAEGRPPMNRYRVNRITSETGSNTDIKYTDIDCVAGALPAPDSNTRRCYPSWWTPEGAVDPVLDWFHKYLVDTVTEHDMVAGSGSPDKVTGYEYLDGAAWRRDNSEFTPDKERTWNDFRGYQRVRTRVGASDKSLAETVYFRGMDGDTLANGQPRPASPLQGVKDSNELAGYVRESTVYDKDGGKPLTSTASTPWVRGTASRATKALPSQDGKPTATPPGESGRPQVAALPPLTAAMVRTESETTKAFQPDGGTARTTRLSRTFDDYGQIRTVSDEGDTNISGDEQCTRTAYVTQDTANWLIAYPQSVQITSTLCSTNATAATVTSETRTAYDGRPVGTAPEPGKGYATTVQALDRYDGATPHYLTATTTAYDQYGRVISVKGANNAETTTSYTPAGGSQPTLVQSTNAKKFTTTTAYDGLRALPVKVIDANNRTIHVDYDAMGRTTAVWNAGRDKSASPSATYTYTIEPGRQPAVTTRTLLEGGDYHTSIALYDGLLRPRQVQDEAHGGSTAHNGGRNITDSFYDSHGRAYRANAAYHADGAPEAALWIGLDNKVPSQTETEFDGLDRPTASIFKSLNVEKWRTVTRYGLNWVATTPPDAGTSTLTVADAHGRPSEVRHYKTGSPDYDAPASAYETLKYTYDSAGKLAKLVDPAGNAWTWEYDLLGRQTKTVDPDKGTTTSAYNADGTLATVTDARGRTLAYTYDVLGRRTGMFDGSTSGTKLAEWAFDSLPGSNGLATGSTRFENGKAYITGITGFDGAARPTGTTVTIPDSEGLLAGTYTAAQTYTPNTGLVDNTTYPAGGGLPQETVRRNYTPLGLPTTVSGGSRVYSLGNTYSPLGQLQQSVTGDIGSRAVQTYDYENATQRLAVVQTDRERSGPQTLEKKTYTYNPVGNITRVRDARDNAAVTDTQCYTYDFAQRLTNAWSATDDCVAKPTPTTDPYVGGVDPYWTSYTYDAAGNRTQATDRTFGAAPGPLMDTTKVTSVAIAGDGQTTAVAIADGQVHIAQQRTDGTWANFENLHRTQAGSLPAPVDYVAAAWADNTLQIMAVAGGRIWHTLRGADGRWGAWGDVTSVVGSIANPSQLSLSATASGLEVLALSDGVLKHTLRKPDGNWSTWGNVYGETGSLTGATRVTSAATGTGLEVIVTAGDKLWHTVRFPGGTWQKWGDVYSATGTLGSPTGITATATGAGLEVAAIVGGSIWHTVRKPDGNWSTWGNVSQVLGRLDQPTSAAVVSSGGDLKLITIAAGSLNYTKRAYATGSWLPWAQLTQTPENPPSDQIQRTSTYPAPGGTRPHALSRVDITGIGARTDTFTYDEAGNTVRRVTADGDQTLDWDIEGHLAKSTTAGKSTTFLYDANGNRLLRREPDAVTLYLDGQELKLDRAANKVTGTRYITAGPVTIVKASDGSLNYLINDQQGSAQLAISADNLDYTRGDTTPFGTPRGRKPASWPTERGFVGGTNDATTGLTHLGARDYDAANGRFISVDPVLDPTDPQQINGYTYSNNNPVNLSDPSGLRPEGTCGGFGACQTPTGEKVQEVWTSDHGVWTDTITKTRPPYQPPAQNTSSGIPGLKKPAPQTAQPDDACGSKAVCAMADKVDDAMRLCAEIGCGVYSVTNYPRNNDSSHDVLRAWLLNAWDNPDVVNFGAGDPLLMDLAKTDEVQVLMEMLLTNYKEKGAKAIGEPLRNQYEDNGPLGTAWLGIPADVLGSLTNGAIGADEAKAVIGSFVVHGTIDSVQSARDGYQVVNMHFTVVNNWNWNSATKMLPADWYPTIPTASGVGWTPGKPIDGHFEWGFRSFVGPSGG

SEQ ID NO: 281 - protein, 115 aa, Streptomyces Sp.
MSQHAPDGTEGQTLPFWVDVVEEEGDEGNAMGGLFRHDGETVLRSVPLGPLRKNLADTVDALQKVFEEVADRGGALPLAEAQLSFQVTATGGIQLIGSGQVQGTRGLTLTFKRPS

SEQ ID NO: 282 - protein, 206 aa, Bacillus Sp.
MKGLVKAAVLTVTLGIGGAFYSSDASAHGYIKEPVSRAYMGALEKQTLGWTAAAQKYGSVIDNPQSVEGPKGFPAAGPPDGRIASANGGSGQIDFGLDKQTADYWVKQNIRGGFNTFTWYYTAPHATSKWHYYITKKNWNPNKPLSRDEFELIGTVNHDGSKADTNLTHKIFVPTDRSGYHVILGVWDVADTSNAFYNVIDVNLTQ

SEQ ID NO: 283 - protein, 2058 aa, Streptomyces Sp.
MQGLSGRIRRPGGRRTLGQSLRAVAATLATVLLATMLAVLNGPTAAAAENPWVPPQQLAGERNIITWNMQGSTAVETGSTYERLNQLYSRAVADAARGAGLVEQKRVVMALQEAGVPPTSWAPLQAAELPNLVVPDGVRGYKRRVGRDYTYLFHAQTIGDDPAGRVNSAIMTNELPRRLVYIPAVAGTLRPLIGVGYGEDRANGEYYFSFHASSGNGGRDIVPMLRRLVAEMGRLEADEHEGHAVNWYVGGDFNLDPTTLRDRLDGPEVNGQDVHIARPERYTHRSPDGTTSMLDYVVTNDPSMSDVLGRVTDQTGYADHDTVYYGRRIGGGAPCARPRVAGLEAAAPEASADPCPLPRPGAIVSMGDSYISGEGGRWAGNALTKQEGDVWGTDRRSKCPDGSQDCVYGATSYDNKGNRCDRSDVAPIKGAEFEDIPVERRLNIACSGATTKDILTESRNNEKPQIQQLADLARTYDIRMVVVSIGGNDLDFSGIVSDCAKAYYRWVEICSAPNKAARVARSVDAVQAEIVKTLAAIRSTMTAAGQSGYQLVLQSYPNPIPAADNFRYPFDGTSDPRFRQGGCPFTDPDADWAHSTLVPKISDMLRRAAGTAGAKFLDVQDAFAGHELCAKGAEQATEANSNASPLPASKAEWVRWVPYIPNLGWLTPNAQGDVQEAIHPNAFGQQALSQCLTGFGKEAPASDRYIFTCTGSGDGMKVVPDGSAVREGIVRLRNAETGEVLDAQGNGTDDYLVTRPDKAEASQRWLLRNVGEKVTLQAQHNGRYLNLWHHLLSGRNWAALGDKETGWFHSAREDGRVALSLDDVDMTTGCLTQDPGRRSEDTNWVGVDSCGQGVKKEQYWYIDYPDDVVITPRQPDAGTDPREGQQVELRSAAGTAVHLSGGSTEAGTSVQAAEPDGSGAQRWVMRSLGGGNWRIAASAKPDMVVDHNPGPHTTHLVQAEEGNANQVWQPKGAGGGWYTLVSSADGGCLTGGGAGEALAVTACDANNQAQRWKFRETGTGTQVGTIRGLEGKCVEPRGGSRDDRTPVALADCAGSDAQAWTVSDDGSLQSLAKCLQVDGGRADNRTAVQLYTCNGSPAQKWIYTARQELRNPNSGKCLDVPDSDTSRPLQIYDCNRRDSQKWQLSARPVGQPDGGDAGDPFDAAPDDRGTKPAASGDCRPEGMAVTPGVAARYCDVYDGAGREWVGNNRTRRVVGYFTGWRAGASGDPKYLASNIPWSKVTHVNYAFAEVRDNRISIGDPNDPANPATGMTWPGEKNAMDASLPYKGHFNLLNTYKKKHPAVKTLISVGGWAGTRNFYAMTTNADGSVNQAGIDAFADSVTDFLDRYGFNGVDIDYEYPTALPDTGNPLDWDVSNPRRKGLQQGYNALMKSLRERLDRAGTDKGRYYLLTSAGSSSGYLVRGLDAGQALQYQDYVDVMTYDLHGSWNRFVGPQAPLYDDGRDNELADAGIYNDQAPDTKDFQKEGYFNVDWAYHYYRGALPAGRINLGIPYYSRGWRDVQGGTDGLWGTAAMPDQAQCPLGTGGRGPANAQSCGTGAVGIDNVWHDLENEREVGAGSNPLWHTKNLQDGRTPGYLRSYGVDTNLPSGQLTGTYAEKYSDALQSPWLWNDAKKVFLSTENEKSLDAKARYIVDKGIGGAMIWELAGDYAQRPGGEWGMGYDLTTRLDNAFKGAGATGNTKAGGRPQPAEVIDVKAELVDFPTGEKDFYPVQPKLRITNNSGVTLAQGTEIALDLPTSMPPVVKDNDYKEMKGLVPGHTGPNTGGLKGDFHRLTLTLGYCEDLAPGKSRDIDLKYYLPITGPSNVTFRIGGREYGSTGDQRRDVRTVTPPAPAAGSSCQAPDWKQGQVYRPDGGRLWRMYDKGDKGWMFEYGDSPAGKPMMIDNNPDQSRAHLVELMEQNANQYWRIQPAGGGLYTIAGGGRCLTATASRQDLASVGCDGRPEQKWRLVPIADNGSEGAPGGPKHNGLFKLRSAAGSDIELAGGATARETHLLTGDPAASTAAFVKYQGSYWYAQWYTTVAPGTAEANGGRPWKKLSPAP

SEQ ID NO: 284 - protein, 956 aa, Stenotrophomonas Sp.
MKYSKLSLALAGLMGVAAISVVDDVMAMNYHVQGDRIFLSGDVTYADVVSLPALLAKAQAEGRPVREVVLRTSNGGALIAGEWLQGIIRTSGLNTIVSGNCISSCSIMQSGGVERYLAGDLPLIDSVQIHAASSGGKVIYTPSPRMTQIYTGNYGGGMDAGLLHKAMYEVVKPNGLLVFRDPARSTGSSVTFDPDGSGSKLESFPGQDIYSNRIITANGYRDPGDTLNVTANVTGDINPGYLRTGRQLQAFVDDDFARWNTDWRSTYINLAQSIYNASSKGPQGIGALSVQGYLSDPDIQDLLLSKLRLADLDVSTLDNAMGVIRVTNGATWRTSATTGADFMLVDNGTIALEGGALRASEVRVLGAGMLVGHGDVAGTAMDRAALLDGTGPSYREDGFNRLRVFGTLMPRGGDLVTHGYVNIMPGGKVLFDVTENGGTAAGRLRVGTFFDDEQTEGALVISKGAFLELNVAQGYYGQDFRRDLVKGPIYQGGFEEAVRLGDTGYSASISGDVFRPRHNSLLSFNVKQTADGLWLTANPGFDQLGLFANGTSGDGLGRALATASDRQDKGLRSLLGALQFADRDVIAQQAGALRGDAHASLRLADTALVGSIGNVVQQHQSAMRSGGDADGLASQVAQSVSSQPGMRHGSLFNQLAMHLVEPAPGSVAGSGDAGRSHGIWARGFASHGRIDAGGGVAGLSHNIGGVVVGADTRVADDRVTLGVSVAAADMSTKASDGSGFTGDVRALDVGGYLDATYARGYLSAAVRYTDLRHDTRRSIGGIDGLQQPLRAKYSNDAISARVEHAFSFTNGKGLVIQPLLPVVDYARTSATRFNEGQGAGALVGRSGSLESIRVGAGLQLFKTFEGNNGERITPRARVVWQKELGDSQARYSTGFAAAPDLMFGASSQAVGEQVLAWNLGVTSRASERLSIMADYVGERRDGQIQNGVMLGLGYRF

SEQ ID NO: 285 - protein, 957 aa, unknown
  environmental sample
MKHSKLSLALAGLMGVTAMAAVDDVMAMNYHVRDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGRITYAPSPRMTQIYTGNYGGGMDAGLLHKAMYEVVQPNGLLVFRDPARTTGTSVTFDPDGSGSKLETFPGQDIRGNNIINTAGYRDPGDTLRVTSNVSGDINPGYLRTARQLQAFVDDDFARWNTDWASTYINYAVSLYNVSTRGPNGIGTPSLQQMLADPDLQDELRGQLRLADLDASTLASSAGVIRVSNGATWRTAETTGADFMLVDNGTIALEGGALRTPELRVMPGSVVVGHGDIASVGTDSDALLDGTGPSYREDGFNRLRVFGTLMPRGGDLVTHGYVNIMPGGQVLFDVTETGGTGSGRLRVGSFYDGGSEEGALVIAQGAHLALNVAQGFYAGTYRRDLVEGPIYQGGFQDAVRLGDTGYSASIAAGEVFRPRHNSLLSFNVNQTADGLWLTANPGFDQLGLFTNGTSGDGLGRALAAASDRQDSGLKSLLGALQFADRDVIAQQAGALRGDAHASLRLADNALIGSIGNVVQQHQAAMRSGGDADGLASQAAQSVSSQPGMRHGSLFNQLAMHLVEPAGEGAGDSRTASGSRGLWARGFASHGRIDADGGVAGLSHNVGGILIGADTRVADDRVTLGVSVAAADMSTKASDGSGFSGDVRALDVGGYLDATYSRGYLSAAVRYTDLRHDTRRSVGGIDGLQQPLRAKYSNDAISARVEHAFSFTTGKGLVIQPLLPVVDYARTSATRFNEGQGAGALVGRSGSLESVRVGAGLQLFKTFEGNNGERITPRARVVWQKELGDTQARYSTGFAAAPDLLFGASSQAVGEQVLAWNLGVTSRASERLSIMADYVGERRDGQIHNGVMLGLGYRF

SEQ ID NO: 286 - protein, 683 aa, Streptomyces Sp.
MTRTRLTALAATATLAATGGLITASPASAAVTCTSPVWKAQYFGNSTFSGTPKLTACDSAISENYGYGDPTGVTLPKDNFSVRWSLTRDFGSGGPFRLSAATQDGMRVYVDGVRKIDLWKNVSTTARKTVDLTVPAGKHTLRVDYVAWTGTANAAFTYAPRTEAAVDTVKPLAPTGLTAAYNRDTTKTTLRWAANKEMDLAGYRVYRRLSTTQWARAGGPSLLTSPSFVDTTPATGQTFLYEVRAVDKAGRESAGSPDATVATVDRTGPAAPTGLRVTSDAWWATLSWQAGADAAKYEVYAASAATGPFELLGTTTTTSYRTDAPMNTARYYRVRALDALGNPSAYATVTGDGVDRTPPKSPTSLGSVVGFGYTDVYWNQPDGFYEDFDNGGTYHVYRSTGKTLDPAALTRVTCAEESDETSTGGKCHDLGMPAGTYVTYAVAAVDPAGNESALSAPLVVRTGDRVAPGPVTGVKATPRTDGVLLSWAASTDDDVESYVVRNGTRQADGTIRWLGTSSCWEGTSDPLAVLCGDVPDGETYVYSVVARDRWGNALLPSDPKVTVVEATELDVRPSVTVTRDWDLGSMGYDSLIGGPGVKGPSINWRCDKTAECDTVAGYRVSRWNAATKAYEPLHAGLLPAETRAYTDTTAVRGTTYFYTLEAVRADGSVAGTHVWSCVLQDRV

SEQ ID NO: 287 - protein, 683 aa, Actinobacteria Sp.
MTRTRLTALAATTALAATGDLMIAAPASAAVSCASPVWKAQYFGNSTFSGTPKLTACDSAVNENYGYGDPTGVTLPKDNFSVRWSLTRDFGSGGPFRLSAATQDGMRVYVDGVQKINLWKNVSTTARRTVDLTVPAGKHTLRVDYVAWTGLAHATFTYAPRAEAAVDTVKPLAPTGLTAAYNRDTAKTTLRWAANKEMDLAGYRVYRRLGTTQWVRAGGSSPLASPSFVDATPATGQTFLYEVRAVDKAGRESVGSLDATAVTVDRTGPAAPTALTVTGDAWWATLAWQGAADAATYEVYAASAATGPFELLGTTTTTSYRTDAPVNTARFYRVRALDALGNPSPYASVTGDGVDRTPPKSPTSLGSVVRVGYTDVYWKQPDGFYEDFDNGGTYRVYRSPGKTLDPAALTRVTCAEESDETSTGGLCHDLDMPAGTYVTYAVAAVDPAGNESALSAPLVVRTGDRVAPGPVTGVTATPRADGILMSWAASTEDDVERYTVWTGARQADGTVKWLTTASCREGTSDPLAVLCGDLPDGETYVYAVVARDLWGNALPPSDPKVTVVEATELDVRPSVTVTRDWDLGSLGHGTVIGGPDEDGPSISWRCDKTAECDTVAGYRVSRWNAATQAYEPLHAGLLPAQTRAYTDTAAARGTTHFYTLEAVRADGGVAGTYVWNCVFQDRV

SEQ ID NO: 288 - protein, 683 aa, Streptomyces Sp.
MTRTRLTALAATAALAATGDLMIAAPASAAVTCASPVWRAQYFGNTTFSGTPKLTACDAAVNENYGYGDPTGVTLPKDNFSVRWSLTRDFGSGGPFRLSAATQDGMRVYVDGVRKISLWQNVSTTARKTVDLTIPAGKHTIRVDYVAWTGLAHAAFTYAPRTEAAVDTVKPLAPTGLTAAYNRDTAKTTLRWAANKEMDLAGYRVYRRLGTTQWARAGGSSLLTSPSFVDATPATGQTFLYEVRAVDKAGRESVGSLDATAVTVDRTGPAAPTGLTVTGDAWWATLAWQGAADAATYEVYAASAAGGPFELLGTTATTSYRTDAPVNTARFYRVRALDALGNPSPYAAVTGDGVDRTPPKSPTSLGSVVRVGYTDVYWKQPDGFYEDFDNGGTYRVYRSPGKTLDPAALTPVTCAEGSDETSTGGLCHDLDMPAGTYVTYAVAAVDPAGNESALSAPLVVRTGDRVAPGPVTGVTATPRADGILMRWSASTEDDVERYAVWTGVRQADGTVKWLTTASCREGTSDPLAVLCGDLPDGETYVYAVVARDLWGNALPPSDPKVTVVEATELDVRPSVTVARDWDLGSLGHGTVIGGPDEDGPSISWRCDRTAECDTVAGYRVSRWNAATQAYEPLHVGLLPAQTRDYTDTTAARGAAHFYTLQAVRADGSVAGTYVWSCVFQDRV

SEQ ID NO: 289 - protein, 683 aa, Streptomyces Sp.
MTRTRLTALAATAAVAAVGGLITAAPASAAVSCTSPVWKAQYFGNSTFSGTPKLTACDSAIAENYGYGDPPGVTLPKDNFSVRWSLTRDFGSGGPFRLSAATQDGMRVYVDGVRKIDLWKNVSTTARKTVDLTVPSGKHTLRVDYVAWTGTANAGFTYAPRTEAGVDRVKPLAPTGFTAAYNRDTRKTTLRWAANKEMDLAGYRVYRRLSATQWAKVSGSSPLTSPSFVDATPATGQTFLYEVRAVDKAGRESAGSLDATTVSVDRTGPATPTGLTVAGDNWWATLAWQGPADAAKYEVYAASAATGPFTLLGTTTTTSYRTEAPVNTLRYYRVRALDVSGNPSAYAAVTGDGVDRTPPAKSPTSLGSVVNVGDTEVYWDQPDGFYEDFDNGGSYRVYRSPGKTLDPAALTGVTCAEWSDETSTGGKCHDRDMPAGTYVTYAVAAVDPAGNESALSAPLVVRTGDRVAPGPVGGVKATPRADGVLVSWAASTEDDVERYVVRNGTRQADGTVKWLGTASCWEGTSDPLAVLCGDLPDGETYVYAVVARDRWGNALSPSDPKVTVVEATELDVRPSVTVVRDWDLGSLGHGSLIGPEQDGPSIGWRCEKTAVCDTVAGYRVGRWNAVTKAYEPLHAGLLPAETRAYTDTTAARGATHFYTLEAVRADGSVAATYVWNCVFQDRV

SEQ ID NO: 290 - protein, 682 aa, Streptomyces Sp.
MTRHRLTALAATAALAATGGLLTATPAAAVTCASPLWKAQYFGNSTFSGTPKLTACDSAIAEDYGYGDPAGVTLPKDNFSVRWSLTRDFGSGGPFRLSAATQDGMRVYLDGVRKIDLWKNVSTTARKTVDLTVPAGRHTLRVDYVAWTGAARAAFTYAPRTEAAVDTVKPLAPTGVTATYDPGTTKTTVRWTANQEMDLAGYRVYRRLGSTSWARVGGASPLTSRSFVDATPATGQTFLYEVRAVDKAGRESAGSLDATAVTVDRTGPAAPTGLTVVGDAWWATVAWQRVADATTYEVYASAAPAGPFALLGTTSTTSYRTDAPENTTRYYRVRALDALGNPSAYATVTGDGVDRTPPKSPTSLGSIADVGATRVYWKQPDGFYEDFDNGGTYHVYRSSGTVLDAAALTRVSCAEQSDETSTGGICHDLDMPEGAYVTYAVAAVDPAGNESALSAPLVVRTGDRVAPGPVTGVKATPRADGVLVSWAASPEDDVERYTAWTGVRQADGTVKWLGSAFCREGTSDPLAVLCGDLPDGETYVYAVVARDRWGNALLPGDPKVTLVEATELDVRPEVTVTRDWDLGGTGYGTVIGGPEEDGPSITWRCDKAAVCESVAGYRVSRWNAATKAYEPLHSGLLPAATRTYTDTTAARGATYFYTLQAVRADGGVAGTHAWSCVFQDRV

SEQ ID NO: 291 - protein, 680 aa, Streptomyces Sp.
MTRTRLSALAATAALATTGGLITAAPASAAVTCTSPVWRAQYFGNSTFSGTPKLTACDTAISENYGYGDPAGVTLPKDNFSVRWSLTRDFGSGGPFRLSAATQDGMRVYVDGVRKIDLWKNVSTTARKTVDLTIPAGKHTLRVDYVAWTGAANAAFTYTPRTEAAVDTVKPLAPTGLTAAYDRTTAKTTLRWTANKEMDLAGYRVYRRLSATSWAKVSGTSLLTTRSFVDAPPATGQTFLYEVRAVDKAGRESTGSPDVTATTVDRTGPAAPTGLTVATGDGWWDTLNWQGVADTAKYEVYASSAAAGPFELRGTTTTTSYRTSGAVNTNTYYRVRALDAAGNPGAYATVTSDGVDRMPPKSPTGVTAGARPGYTNVHWSQPDGFYEDWDNGGHYRVYRSPGKTFDPTARTQVTCVAEESHEASNGGNCYDVDMPANTYVTYAVTAVDPYGNESAYSAPVVVRTGDTVAPGPVTGVKVTPRNDGMLVSWAASPEDDIDEYVVWTGVRQADGTVKWLGPATCAEGTSNWLAILCGNLPDGEAHVYAVTAKDHWGNTLHPSDPKVTVVEATELDVRPSVTVTRDWSLGSLGHNRTTTRPSVDWQCTDTTRCATVTGYRVSRWNPATKAYEPQHDGLLPADARTWEDATATKGNTYFYTLEAVTADGAVVGTYPWYTVFQDRV

SEQ ID NO: 292 - protein, 669 aa, Streptomyces Sp.
MTRTRLSTLAATAVLAAVGGLITAVPASAAVTCTSPVWTAQYFANTSFSGTPKLTACDSAIAENMGSGDPAGVTLPNDNFSIRWSLTRDFGSGGPFRLAAATQDGMRVYVDGVRKINLWTNVSTTARKTVDLNIPAGRHTIRVDYVAWTGSAYAGFTYTPRTEASVDTVKPLAPTGLTAAYSRDTAKTTLRWTANKEMDLAGYRVYRRLSTTPWAKVSGSSLLTTPSFVDTPPATGQTFLYEVRAVDKAGRESTGSVDVTAATVDRTGPAAPTGLTVVSDAWMATLSWQAVSDAATYEVYASSAATGPFELLITATTTSYRTSAPTNANQYYRVYATVAGDGVDRTPPGSPSGLNSVARPGSTAVYWTAPGGRWVEDWDNGGHYRVYRSPGKTFDPAARTEVACAEEGSNEAGNGGACVDLGMPVNTYVTYAVTAVDPDGNESAYSAPLVVRTGDTVAPGPVTGVKVIPRSDGMLVSWAASPEDDIDEYVVWAGARQADGTVKWLGPDRCWEGVSNPLAILCGNLPDGETRVYAVIAKDHWGNGLHPSDPKVIAVEATELNVRPSVTVTRDWNLGSLSHNPTAARPSVDWQCTDTTRCGTVTGYRVSRWNPATKTYESQHDGLLPADARTWTDLTATKGNTYFYTLEAVTADGAVVGTYPWYTIFHDRV

SEQ ID NO: 293 - protein, 755 aa, Streptomyces Sp.
MRISLGTTRRTGGAAVLSLATALAGLAFPTTAHAAVTCSAGVWKAQYYANTTLSGTPKATVCDSAVAENYGSGDPSGVTLPNDNFGVRWTTTRNFGSGGPFDLSLAVQDGARVYLDGSRKIDLWRNVTSTQRKTVRLTIPRGSHTLRVDFAAFTGTANISFSYAPVIGATYDKTVPLSPVGVKSSFSASTLKTTLTWSRNYEMDMAGYRVYRRVAGTSSWSLRNSTLITGTTFNEAPPATGAAYEYALRAVDRSGNVSPLSAVTSVVSADRTAPAVPTGLTATYDPSAGARLAWSPASGASSYEVQRAVAPEGPFAPVGAPLQGAALTDPAAAVGTTYYYRVRAKDGAGNASAYSAPVRLDAAEAKPLPPTAVSATGRLDRNTVGWQYDGDASHQFHVYGADSAAGPWTRLTDTPVAGTSYDDHAAPVGEARYYQVRTVTTLGTESDPSTTASATRIRDVTPPHMPYGLDAWDATDGVHLVWTPNTDDTDHYLVMRKTMFGAWEQIAVVRDGTYLDTSTAPDVQFGYTVRAVDGAGNVSPLPEPGYGTVYGKRLPVYEKPAAPASVTATADNGNVKVEWTPSTSTDVAGYYVYRTTVTDPTTAYSVSPLITGTTFTNVDVPAGNSWYYVVRVVSTHSQWSDYSPMAAVTVPCPVLTGPPTPRITGGGRGADYAQLNWQVGTCDQGATVSYNVYRSTSSADVFTPERRIATGVTALTYKDPGLARAYYYYVVTAVAADGTESAPQATPFGISMMAP

SEQ ID NO: 294 - protein, 668 aa, Streptomyces Sp.
MRSRRGTRRAVGTALVGAVACLALPASGAQAATTCAAGVWKASYYANTTFAGTSKLTVCDTAISESYGTRDPAGVTLPRDNFGVRWTMTRNFGSGGPFTFSVAVQDAVRVYLDGTRKINLWSNVSSTRSKTVNVTVPKGTHTIRVDFAAFTGSANVKFGYAPKTSATVDKTAPLAPTGARVSYDQASSKATFTWSKNKEMDLAGYKVYLRRPGTSTLVVRTTATSYTTTLPATGAVYRFGVDAVDRAGNTSSSGIDLPVTTADRTAPQAPIGLTAADSQWDVTLSWTASEAGSTFRVYRADSTTGPYSLVGTTKSTWLTLTDAPYSTPRHYKVTATDVSGNTSAASAVLSYTRPTAVPWLYHAENNEADTGIRLLWEARLNAGTTGFRVYRAEPGSADPSWHAVTCEDFGQGGSTPYVQVHYCTDRSAVARTAYQYTVTSVDAKGRESERSVPYSITRVDRTPPPAVTGVTAKATPYGVVLDWDPSTAPDIAKFIIRREPEEKLPCWCNLAEVDAATTHFVDAELPDGETLTYSVDAVDTSGNSLYTLYLNPEDEGMTFADVTELDLTPSVDTPAGAPLDLTATAADSGHTVELRWDAIGEATGYRVHRWNPDAAAYEPLTAEPVTDLSYTDTTAATGTTHFYWVTAVYADGTESAPGAAWTILQPGS

SEQ ID NO: 295 - protein, 669 aa, Streptomyces Sp.
MTPARRTTAVATTAVVLATAGTLLTTAPAANAAVTCASPVFKRQFYANTGFSGTPKKTDCDSAINENWGAGAPASGLPSNNFGVRWTVTRDFGSGGPFTFTAAAQDGIRVYVDGKRKIDLWKNVSSTQTKTLNLTIPSGKHTLRVDYVNWTGSANVKFTYAPRTSATVDKVKPLAPKGISVAYGKATNKARLTWAKNAEMDLAGYRVYRRLSTASTWTKVGTTTATSTTAYTDSPPATGKSYVYEVRAYDKAGNTSTGSADLSVTAITLATPTGLTATGADAGIAVSWQPVAGAVKYRLAHDDSGAYTTVTGTSYTDSSVARSVYRSYKVAAVDASGHVSAYSAVTAQVRRPVAAPYGMVASAASGTGVYRLYVNWTVNTATGGAYDTFHVYRSTSLPVDTTAEPFVCDDLSYNIGDDERGYSCRDEQVAPATTYHYVVKGVDDTGTESLPSATVSVATPTPDTTAPAPVTGLTATPTKYGIELDWADNAESDVVRYVVYRGVPAGDGDGQSCGSLGQIGTAFKSQYTHLTLPDGGRNCYLVDAVDDAGNSAYTATGQATTVHVTELDVRPSVASPTEPPVTVNGFYDTSFGRVELSWNVRYPYDTNKYYVYRWNPATQAYEKLTTTPLTTKRYFDTTAEPGTTHFYWVTVAYTNGESEPGSTYVIRQP

SEQ ID NO: 296 - protein, 378 aa, Bacillus Sp.
MFILAAAVLCFFYFRTEEPAEVDREILNAPDFLKNKEALLYFSTAADQDTFGGGKSYALFADKKGRLSSYQMKGLELGSAKVHDGSVLLEDKKGIYTVQNGLHTYKRTYQHTGDSAGYIERTKGFYTLYNSGYDKSGGSYRSELYRQIDGRWKQNVIPHYIRASGFFKDHLFALTPTYDEKGYHIEDIQADKEKLHTKSIATWTYKEGTSVESQLAADDGAVCFVTRGEKAEHIYQMVKVMRKSGAIKTYDIATYRNDEQTIYDSMPFSFKKSFFMERRSFYFVDGFGTVYRINPETGKSKKAFTLPASRMKADFKDLTHQNGKLYLFTYSYKKPAKIESFDLKTGKKLNDRTIPSLQDIVSPKSHLKLYDVQVMDGF

SEQ ID NO: 297 - protein, 355 aa, Rhodococcus Sp.
MRKKSLGLKGRIALALSLSVAGVVATQAPAIADTWSNGHIVKGAIEAEWLRLGPDNVGWAVTDELDANYLGKFQVFERPAPHMGNSIYWHNDTGAHQVGGLIRDKYRDLGWESGDLHFPTTSETQTPIKPGAFNHFQGGSIYYSSSTGAWPTWGAIRDTWANAGWENSGYGFPKSYEYNCNDGINPNDKSWNYGGKGQDYQGGRIFWNSAPNNFNLPYSSVHGSPRTLKYSSTTKYTSAQSNAISQWNALGRVNIEPATVLNNEVLVVRDINRSDYTWAGLYTYRGADFSTLEMNDAKFTGPSDSRIPRVMTHEWGHSLGLAHSCVGSNMDELIYFNNNPNLSDLDKSSYNTKHP

SEQ ID NO: 298 - protein, 1228 aa, Streptomyces Sp.
MHRKRPRARTLLALLTGALLAGSSLSAVPAAAHPDEPAAEESFQQVTLAKGADAVGEPMSLAVLPDRRVLHTSRDGTLRITDAGGDTTVSGTLDVYNHDEEGLQGVGVDPDFAENRAIYLFYAPKLDTPAGDAPENGTAADFAPFDGYNRLSRFTLNEDGTLDKASEKKVLDVTTSRGTCCHVGGDIAFDADGNLYLSTGDDTNPFASDGYTPIDERADRNPAFDAQRSSGNTNDLRGKVLRIKVAEDGSYTIPEGNLFAPGTEKTRPEIYAMGFRNPFRISVDKKTGIVYVGDYGPDAGAASPTRGPAGQVEFARVTEAGNFGWPYCTGDNDPFIDYDFATKASGAAFDCAAPKNTSPHNTGLTDLPPAQAAWIPYDGGSLPEFGSGSESPMGGPVYRYDADLDSPVKFPEEYDGDFFAGEFGRQWIKRIEQGEDGTVSKINPFPWSGTQPMDMEFGPDGALYVLDYGLSWFGGDEHSALYRIENSTGGKSPIAEATATKTSGKSPLKVTFSSAGTEDPDGDALTYAWDFGDGGTSTETSPSYTYKKNGTYTARLTVTDPTERTATASVRIVVGNTAPKVTLELPNDGHLFNFGDTVPFKVKVTDPEDGVIDCSKVVVRYILGHDSHGHPITSANGCEGTITAPADTEHDPNANIFGVIDAEYTDGGGGGQAALTTHDQSQLQPRHRQAEHFNNSSGIKVYDKAPANGGKTVGDIDNGDWISFSPYNLTGSKTLTARISSGGAGGFLEVRSGSANGNLLGSAPIPVTGGWETFQDIDVPLRAVPKQTTELFLVFKGGAGGGALYDLDDFQLSTAVPGKTEKRVLVFSKTGGFRHDSIPAGIAALKELGKTTGITVDATEAAGQFTTNNLARYDAVVFLSTTGDVLNADQQKAFENYVATGGGYLGVHAAADTEYDWSFYGGLVGAYFDSHPQIQPATVRVEDHDNPSTAHLGDEWQRTDEWYNYRTNPRDQARVLATLDETTYQGGNMKGDHPIAWCQTYEGGRAFYTGGGHTKESYADDAFRQHLLGGLRYAAGQVKADCTPKTGYRDLFNGKTLEGWKQAGPGKFNVVDGELRSEGGMGLLWYQAKQLESYSLKLDWKMDGDDNSGVFVGFPASDDPWSAVDKGYEIQIDATDAADRTTGSVYGFKSANIKARDQVLRPPGQWNNYEIKVQGERLQIFLNGVKINDFTNKDPERSLKDGYIGLQNHGADDQVSFRDVQLKELPSA

SEQ ID NO: 299 - protein, 250 aa, Bacillus Sp.
MMCKKLFKAVLPFALSFTMVLSFSGMNVKAKETEAARYAKEIADLQQGTTPQDVLQSAKELAKQKHVSTEAILKQFHQEITADKVQGNVIVSKEGLSAMGGSSGTKKLPKSTKGNIYYTNSYTAYYNHGHVGMYSSADKIVESVPGDGVRQIAYNGREVEDNSIVQTVKVTDAQKQAAADWAVSRVGDEYSFNFVNNRNTGHEGAKNCSKLLWSAFLLKAGIDIDSNGGLGVYPRDITSSSYTTTILTIH

SEQ ID NO: 300 - protein, 250 aa, Paenibacillus Sp.
MMCKKLFKAVLPFALSFTMVLSFSGMNVKAKETETARYAKEIAELQQGTTPQDVLQSAKELAKQKHVSTEAILKQFHQEITADKVQGNVIASKEGISAMGGSSGTKKLPKSTKGNIYYTNSYTAYYNHGHVGMYSSADKIVESVPGDGVRQIAYNGREVEDNSIVQTVKVTDAQKQAAADWAVSRVGDEYSFNFVNNRNTGHEGAKNCSKLLWSAFLLKAGIDIDSNGGLGVYPRDITSSSYTATILTIH

SEQ ID NO: 301 - protein, 249 aa, Bacillus Sp.
MCKKLFKAVLPFALSFTMVLSFSGLNVKAKETEIPRYAKEIADLQQGTTPQDVLQSAKELAKQKHVSTEAILKQFHQEITADKVQGNVIASKDGLSAMGGSSGTKKLPKSTKGNIYYTNSYTAYYNHGHVGMYSSADKIVESVPGDGVRQIAYNGREVEDNSIVQTVKVTDAQKQAAADWAVSRVGDEYSFNFVNNRNTGHEGAKNCSKLLWSAFLLKAGIDIDSNGGLGVYPRDITSSSYTTTILTIH

SEQ ID NO: 302 - protein, 249 aa, Bacillus Sp.
MCKKLFKAVLPFALSFTMVLSFSGMNVKAKETEAARYAKEIAELQQGTTPQDVLRSAKELAEQKHVSTEAILKQFHQEITADKVQGNVIASKDRLSAMGGSSGTKKLPKSTKGNIYYTNSYTAFYNHGHVGMYSSADKIVESVPGDGVRQIAYNGREVEDNSIVQTVKVTDAQKQAAADWAVSRVGDEYSFNFVNNRNTGHEGAKNCSKLLWSAFLLKAGIDIDSNGGLGVYPRDITSSSYTTTILTIH

SEQ ID NO: 303 - protein, 249 aa, Bacillus Sp.
MCKKLFKAVLPFALSFTMVLSFSGTNVKAKETEAARYAKEIAELQQGTTPQDVIRSAKELAEQKHVSTEAILKQFHQEITADKVQGNVIASKDGLSAMGGSSGTKKLPKSTKGNIYYTNSYTAFYNHGHVGMYSSADKIVESVPGDGVRQIAYNGREVEDNSIVQTLKVTDAQKQAAADWAVSRVGDEYSFNFVNNRNTGHEGAKNCSKLLWSAFLLKAGIDIDSNGGLGVYPRDITSSSYTTTILTIR

SEQ ID NO: 304 - protein, 262 aa, Bacillus Sp.
MEKLYSKKRGEVMMCKKLFKAVLPFALSFTMVLSFSGMNVKAKETETARYAKEIAELQQGTTPQDVLQSAKELAKQKHVSTEAILKQFHQEITADKVQGNVIASKEGISAMGGSSGTKKLPKSTKGNIYYTNSYTAYYNHGHVGMYSSADKIVESVPGDGVRQIAYNGREVEDNSIVQTVKVTDAQKQAAADWAVSRVGDEYSFNFVNNRNTGHEGAKNCSKLLWSAFLLKAGIDIDSNGGLGVYPRDITSSSYTTTILTIH

SEQ ID NO: 305 - protein, 250 aa, Bacillus Sp.
MKCKKMFKAVIPFALMFAMVLPFSGMNVKAKETETARYAKEIAELQQGTTPQEVIQSAKELAKQKHVTTEAILKQFHSEITADKVQGDVIASKQGLSAMGGSSGTKKLPKSTKGNIYYTNSYTAYYNHGHVGMYSAADQIVESVPGDGVRQIAYNGREVEDNSIVQTVSVTDAQKQAAADWAVSRVGDEYSFNFVNNRNTGHEGAKNCSKLLWSAFLLKAGIDIDSNGGLGVYPRDITSSPYTTTILTIN

SEQ ID NO: 306 - protein, 387 aa, Bacillus Sp.
MKKIIWIPLVIIAAAAVLCFFYFRTEDPAEVDRDTLNDPDFLKDKEALLYFSTAADQDTFGGGKSYAIFADEKGRLSSYHMKGLELGSAKVHDGSVLLEDKKGIYTVQGGLHTYKRAYQHTGDSAGYIERTKGFYTLYNSGYDKSGGSYRSELYRQIDGKWKQNVIPHYIRASGFFKDHLFALTPTDDEKGYHVQDIQADKEKLHTTSIATWTYKEGTSVESQLAADDSAVCFVTRGEKADHIYQMVKVMKNSGAIKTYDIAAYKNEEQTIYDSMPFSFKKSFFMERRSFYFVDGFGTVYRINPETGKSKKAFTLPPSRMKADFKELTHQNGKLYLFTYSYKKPAKIESFDLKTGKKLNDLTIPNLKNIVTPKSHLKLYDVQVMGGF

SEQ ID NO: 307 - protein, 387 aa, Bacillus Sp.
MKKIIWIPLVIIAAAAVLCFFYFRTEDPAEVARDTLNDPDFLKDKEALLYFSTAADQDTFGGGKSYALFADEKGRLSSYQMKGLELGSAKVHDESVLLEDKKGIYTVQGGLHTYKRAYQHTGDSAGYIERAKGFYTLYNSGYDKSGGSYRSELYRQIDGMWKQDVIPHYIRASGFFKDHLFALTPTDDEKGYHIQDIQADKEKLHTTSIATWTYKEGTSVESQLAADDSAICFVTRGEKADHIYQMVKVMKNSGAIKTYDIAAYKNDEQTIYDSMPFSFKKSFFMERRSFYFVDGFGTVYRINPETGKSKKAFKLPASRMKADFKELTHQNGKLYLFTYSYKKPAKIESFDLKTGKKLNDRTIPNLKNIVTPKSHLKLYDVQVMGGF

SEQ ID NO: 308 - protein, 387 aa, Bacillus Sp.
MKKIIWIPLVIIAAAAVLCFFYFRTEDPAEVARDTLNDPDFLKDKEALLYFSTAADQDTFGGGKSYALFADEKGRLSSYQMKGLELGSAKVHDESVLLEDKKGIYTVQDGLHTYKRAYQHTGDSAGYIERAKGFYTLYNSGYDKSGGSYRSELYRQMDGRWKQDVIPHYIRASGFFKDHLFALTPTDDEKGYHVQDIQADKEKLHTTSIATWTYKEGTSVESQLAVDDSAVCFVTRGEKADHIYQMVKVMKNSGAIKTYDIAAYKNDEQTIYDSMPFSFKKSFFMEHRSFYFVDGFGTVYRINPETGKSKKAFTLPASRMKADFKELTHQNGKLYLFTYSYKKPAKIESFDLKTGKKLNDLTIPNLKNIVTPKSHLKLYDVQVMDGF

SEQ ID NO: 309 - protein, 387 aa, Bacillus Sp.
MKKIIWIPLVIIAAAAVLCFFYFRTEDPAEVARDTLNDPDFLKDKEALLYFSTAADQDTFGGGKSYALFADEKGRLSSYQMKGLELGSAKVHDGNVLLEDKKGIYTVQNGLHTYKRAYQHTGDSAGYIERTKGFYTLYNSGYDKSGGSYRSELYRQIDGRWKQNVIPHYIRASGYFKDHLFALTPTDDEKGYHIQDIQADKEKLHTKSIATWTYKEGASVESQLAADDGAVCFVTRGEKAEHIYQMVKVMRKSGAIKTYDIAAYKNDEQTIYDSMPFSFKKSFFMEHRSFYFVDGFGTVYRINPETGKSKKAFTLPASRMKADFKELTHQNGKLYLFTYSYKKPAKIESFDLKTGKKLNDLTIPNLKNIVTPKSHLKLYDVQVMDGF

SEQ ID NO: 310 - protein, 394 aa, Paenibacillus Sp.
MKKIISIPLVIIAAAAVLCFFYFPTEDPAEVARDTLNDPDFLKDKEALLYFSTAAEQDTFGGGKSYALFADEKGRLSSYQMKGLELGSAKVHDESVLLEDKKGIYTVQDGLHTYKRAYQHTGDSAGYIERAKGFYTLYNSGYDKSGGSYRSELYRQMDGKWKQDVIPHYIRASGFFKDHLFALTPTDDEKGYHVQDIQADKEKLHTNSIATWTYKEGTSVESQLAADDSAVCFVTRGEKADYIYQMVKVMKNSGAIKTYDIAAYKNDEQTIYDSMPFSFKKSFFMERRSFYFVDGFGTVYRINPKTGKSKKAFTLPASRMKADFKELTHQNGKLYLFTYSYKKPAKIESFDLKTGKKLNDLTIPNLKNIVTPKSHLKLYDVQVMEGFEKEKQSS

SEQ ID NO: 311 - protein, 394 aa, Streptococcus Sp.
MKKIIWIPLVIIAAAAVLCFFYFRTEDPAEVARDTLNDPDFLKDKEALLYFSTAADQDTFGGGKSYALFADEKGRLSSYQMKGLELGSAKVHDGNVLLEDKKGIYTVQNGLHTYKRAYQHTGDSAGYIERTKGFYTLYNSGYDKSGGSYRSELYRQIDGRWKQNVIPHYIRASGYFKDHLFALTPTDDEKGYHIQDIQADKEKLHTKSIATWTYKEGASVESQLAADDGAVCFVTRGEKAEHIYQMVKVMRKSGAIKTYDIAAYKNDEQTIYDSMPFSFKKSFFMEQRSFYFVDGFGTVYRINPKTGKSKKAFTLPASRMKADFKELTHQNGKLYLFTYSYKKPAKIESFDLKTGKKLNDLTIPNLKNIVTPKSHLKLYDVQVMDGFEKEKQSS

SEQ ID NO: 312 - protein, 387 aa, Bacillus Sp.
MKKIIWIPLVIIIAAAVLCFFHFRTEEPAEVERETLNDPDFLKDKEALLYFSTTADQDTFGGGKSYALFADKKGRLFSYQMKGLELGSAKVHDESVLLEDKKGIYTVQDGLHTYKRAYQHTGDSAGYIDRTEGFYTLYNSGYDKSGGSYRSELYRQIDGKWKQDVIPHYIRASGFFKDHLFALTPTDDEKGYHVQDIQADKERLHTNTIATWTYKEGTSVESQLAADDSAVYFLTRGEKADHIYQMVKVMRNSGAIKTYDIASYKNDEQTLYDSMPFSFKNSFFMEQRSLYFVDGFGTVYRINPETGKSKKAFTLPASGMKADFKDLTHQNGKLYLFTYSYKKPAKIESFDLKTGKKLNDRTIPNLKNIVTPKSHLKLYDVQVMDGF

SEQ ID NO: 313 - protein, 378 aa, Bacillus Sp.
MIILAAAGLCFFYFRTEEPAEVDRETLNDPDFLKDKEALLYFSTAADQDTFGGGKSYALFADKKGRLSSYQMKGLELGSAKVHDGSVLLEDKKGIYTVQNGLHTYKRTYQHTGDSAGYIEQTKGFYTLYNSGYDKSGGSYRSELYRQIDGRWKQNVIPHYIRASGYFKDHLFALTPTDDEKGYHIQDIQADKEKLHTKSIATWTYKEGTSVESQLAADDGAVCFVTRGEKAEHIYQMVKVMRKSGAIKTYDIAAYKNDEQTLYDSMPFSFKKSFFMEQHSFYFVDGFGTVYRINPETGKSKKAFTLPASRMKADFKELTHQNGKLYLFTYSYKKPAKIESFDLKTGKKLNDRTIPSLQDIVSPKSHLKLYDVQVMGGF

SEQ ID NO: 314 - protein, 387 aa, Bacillus Sp.
MKKLIWIPLVIIISAAVLCFFHFRTEDPAEITRDTLNNPDFLKDKEALLYFSTTADQDTFGGGKSYALFADEKGRLSSYQMKGLELGSAKVHDGSVLLEDKKGVYTVKDGLHTYKRAYQHTGDSAGYIDRTDGFYTLYNSGYDKSGGSYRSELYRQIDGKWKQDVIPHYIRASGFFKGHLFALTPTDDEKGYHATDIQAEQEKLSTKTIATWTYKEGTSVESQLAADDNAIYFLTRGEKADHIYQMVKVMKNSGAIKTYDIASYKDDEQTLYDSMPFSFKKSFFMEQHQLYFIDGFGAVYRISPETGKSKKAFTLPAAGMKADFKDLTYQNGKLYLFTYSFKHPAKIEEFDLKTGKKLKERTIPNLKDIVTPKSHLKLYDVQVMKDF

SEQ ID NO: 315 - protein, 387 aa, Bacillus Sp.
MKKLIWIPLVIIIAAAVLCVFHFRTEDPAEITRDTLNNPDFLKDKEALLYFSTTADQDTFGGGKSYALFADEKGRLSSYQMKGLELGSAKVHDGSVLLEDKKGVYTVKDGLHTYKRAYQHTGDSAGYIDRTDGFYTLYNSGYDKSGGSYRSELYRQIDGKWKQDVIPHYIRASGFFKGHIYALTPTDDEKGYHATDIQAEQEKLSAKTIATWTYKEGTSVESQLAADDNAVYFVTRGEKADHIYQMVKVMKNSGTIKTYDIASYKDDEQTLYDSMPFSFKKSFFMEQHQLYFIDGFGAVSRINPETGKSKKAFTLPAAGMKADFKDLTYQNGKLYLFTYSFKHPAKIEEFDLKTGKKLEERTIKNLQKIVTPKSHLKLYDVQVMKDF

SEQ ID NO: 316 - protein, 182 aa, Bacillus Sp.
MKRFITRASGNTISKKLVLMMLPMVLMILMITPSNDVSAANLSKAGSLKGVNLFNGSWTVAIQAANLQYVSAEPLGNVIANRNAVNEWEKFELIPTGELYTYALKAKSNGKYVSFEPNGRVVADRTSIGAWEKFILYNGGDNRIYVLQALSNGRYISANGGRELTATSYVAGSWERFVIVYF

SEQ ID NO: 317 - protein, 190 aa, Bacillus Sp.
MHIKGGMGMKRFITRASGNTISKKLVLMMLPMVLMILMITPSNDVSAANLSRAGSLKGVNLFNGSWTVAIQAANLQYVSAEPSGNVVANRNAVNEWEKFELIPTGELYTFALKAKSNGKYVSFEPNGRVVADRTSIGAWEKFILYNGGDNRIYVLQALSNGRFISANGGRELTANSYVAGSWERFVIVYF

SEQ ID NO: 318 - protein, 182 aa, Bacillus Sp.
MKRFITRASGNTISKRLVLMVLSMVLMIVMITPSNDVSAANLSKAGSLKGVNLFNGSWTVAIQAANLQYVSAEPSGNIIANRNAVNEWEKFELISTGELYTYALKAKSNGKYVSFEPNGRVVADRTSIGAWEKFILYNGGDNRIYVLQALSNGRYISANGGRELTATSYVAGSWERFVIVYF

SEQ ID NO: 319 - protein, 182 aa, Bacillus Sp.
MKRFITRASGNTISKRLVLMVLSMVLMIVMITPSNDVSAANLSKAGSLKGVNLFNGSWTVAIQAANLQYVSAEPSGNIIANRNAVNEWEQFELISTGELYTYALKAKSNGKYVSFEPNGRVVADRTSIGAWEKFILYNGGDNRIYVLQALSNGRYISANGGRELTATSYVAGSWERFVIVYF

SEQ ID NO: 320 - protein, 190 aa, Bacillus Sp.
MYIKGGMEMKRIITRASGNTISKKLVLMMLPMVLMILMITPSNDVSAANLSKAGSLKGVNLFNGSWTVAIQAANLQYVSAEPLGNVTANRNAVNEWEKFELIPTGELYTYALKAKSNGKYVSFEPNGRVVADRTSIGAWEKFILYNGGDNRIYVLQALSNGRYISANGGRELTATSYVAGSWERFVIVYF

SEQ ID NO: 321 - protein, 190 aa, Bacillus Sp.
MYIEGGMGMKRFITRASGNTISKKLVLMMLPMVLMILMITPSNDVSAANLSKAGSLKGVNLFNGSWTVAIQAANLQYVSAEPLGNVTANRNVVNEWEKFELIPTGELYMYALKAKSNGKYVSFEPNGRVVADRTSIGTWEKFILYNGGDNRIYVLQALSNGRYISANGGRELTATSYVAGSWERFVIVYF

SEQ ID NO: 322 - protein, 190 aa, Bacillus Sp.
MYIKGGMGMKRFITRASGNTISKRLVLMVLSMVLMIVMITPSNDVSAANLSKAGSLKGVNLFNGSWTVAIQAANLQYVSAEPSGNIIANRNAVNEWEKFELISTGELYTYALKAKSNGKYVSFEPNGRVVADRTSIGAWEKFILYNGGDNRIYVLQALSNGRYISANGGRELTATSYVAGSWERFVIVYF

SEQ ID NO: 323 - protein, 182 aa, Bacillus Sp.
MKRFITHANGNKIFKKLVLMVLPMVLMIMMITPSNGALAADQSNTGSLKGVSLFNGSWTVAIQAANLQYVSAEPSGNVVANPSSVNKWEKFELIPTGELYTFALKTKSNGKYVSFEPNGRVVADRTSIGAWEKFILYNGGDNRIYVLQALSNGRFISANGGRELTANSYVAGSWERFIIVYF

SEQ ID NO: 324 - protein, 184 aa, Bacillus Sp.
MGMKRFITHANGNKIFKKLVLMVLPMVLMIMMITPSNGALAADQSNTGSLKGVSLFNESWTVAIQAANLQYVSAEPSGNVVANPSAVNEWEKFELIPTGELYTFALKTKSNGKYVSFEPNGRVVADRTSIGAWEKFILYNGGDNRIYVLQALSKGRFISANGGRELTANSYVAGSWERFIIVYF

SEQ ID NO: 325 - protein, 193 aa, Bacillus Sp.
MSAIYIKGGMGMKRFITHANGNKIFKKLVLMVLPMVLMIMMITPSNDALAADQSNTDSLKGVSLFNGSWTVAIQAANLQYVSAEPSGNVVANRSAVNEWEKFELIPTGELYTFALKTKSNGKYVSFEPNGKVVADRTSIGAWEKFILYNGGDNRIYVLQALSNGRFISANGGRELTANSYVAGSWERFVIVYF

SEQ ID NO: 326 - protein, 193 aa, Bacillus Sp.
MSAIYIKRGMGMKRFITHANGNKIFKKLVLMVLPMVLMIMMITPSNGALAADQSNTGSLKGVSLFNGSWTVAIQAANLQYVSAEPSGNVVANPSAVNKWEKFELIPTGELYTFALKTKSNGKYVSFEPNGRVVADRTSIGAWEKFILYNGGDNRIYVLQALSNGRFISANGGRELTANSYVAGSWERFIIVYF

SEQ ID NO: 327 - protein, 196 aa, Bacillus Sp.
MMYMSAIYIKRGMGMKRFITHANGNKIFKKLVLMVLPMVLMIMMITPSNGALAADQSNTGSLKGVSLFNGSWTVAIQAANLQYVSAEPSGNVVANPSAVNKWEKFELIPTGELYTFALKTKSNGKYVSFEPNGRVVADRTSIGAWEKFILYNGGDNRIYVLQALSNGRFISANGGRELTANSYVAGSWERFIIVYF

SEQ ID NO: 328 - protein, 202 aa, Bacillus Sp.
MFYIFGMMYMSFMYIKGGMGMKRFITRARGNTVSKNLVLMVLSMVLMIFMITPSNDVSAANLSKAATLKGVNLFNGSWTVAIQAANLKYVSAEPLGNVTANRNAVNEWEKFELIPTGELYTYALKAKSNGKYVSFEPNGRVVADRTSIGAWEKFILYNGGDNRIYVLQALSNGRYISANGGRELTATSYVAGSWERFVIVYF

SEQ ID NO: 329 - protein, 153 aa, Bacillus Sp.
MITPSNDVSAANLSKAGSLKGVNLFNGSWTVAIQAANLQYVSAEPSGNIIANRNAVNEWEKFELISTGELYTYALKAKSNGKYVSFEPNGRVVADRTSIGAWEKFILYNGGDNRIYVLQALSNGRYISANGGRELTATSYVAGSWERFVIVYF

SEQ ID NO: 330 - protein, 971 aa, Bacillus Sp.
MKGYSKKMLVGVSFASLMLGSFQGVSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGTFHSTGTKGLQVVTDAMKIYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHAPKPVSDIAAEITAEAKLKNVSVKKNKSQFFNTFTLQGTYTGTAAKGEYEDWKTITQNVNDTLKRLSAKEWTGYKTVTAYFVNYRVNASGQFEYDVVFHGINTEEWAENKAPVAVINGPYSGNVNEAISFKSDGSKDEDGKITSYKWEFGDGTVSNEQNPTHVYTKEGTYTTKLTVTDDKGVTNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 331 - protein, 971 aa, Bacillus Sp.
MKGYSKKMLVGVSFASLMLGSFQGGSLAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQAIIDKLKQQGQAYTKDDSKGIETLVEVLRSGFYLGFYNSELSKLNERGYHDKCLPALKAIANNSNFKLGTLEQNRVVSSYGKLIGNASSDVETITSAAKIFKQYNDNFSTLVDNLSAGNAIYDIMQGIDYDIQSYLYDTRKEPKDTVWYQKIDSYINELSRFALMGTITEKNGWLINNGIYYTGRLGMFHNTGTKGLQVVTDAMKIYPYLGEQYFVAAEQIATNYGGKDANGNVVNLDQIREEGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTLEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKRVSDIAAEITAEAKLKNVSVKKNKSQFFNTFTLQGTYTGTTAKGEYEDWKTITQNVNDTLKRLSAKEWTGYKTVTAYFVNYRVNASGQFEYDVVFHGINTEEGAENKAPVAVINGPYSGNVNEAISFKSDGSKDEDGKITSYKWEFGDGAVSNEQNPIHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 332 - protein, 945 aa, Bacillus Sp.
MAEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQTIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVNYDIQSYLYDTRKAPKDTVWYQKIDSYINELSRFALMGTITAKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKSQFFNTFTLQGTYTGTAAKGEYEDWKTITQNVNDTLKRLSAKEWTGYKTVTAYFVNYRVNTSGQFEYDVVFHGINTEEGAENKAPVAVINGPYSGNVNEAISFTSDGSKDEDGKITSYKWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 333 - protein, 964 aa, Bacillus Sp.
MLVGVSFASLMLGSFQGVSLAEDTKGEQVSYRNVLKMEPVGVQLPVQELAHSSKLLESKSFEQRIQFADLSQRPPEVKKESKQLAVAKTYTIAELNQLSNQQLVDLLITIDWEQITGLFQFNTDSLAFYQNDSRMQAIIDKLKQQGQAYTKDDSKGIETLVEVLRSGFYLGFYNSELSKLNERSYHDKCLPALKAIANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGSFHSTGTKGLQVVTDAMKIYPYLGEQYFVAAEQIATNYGGKDANGKVVNLDQIREDGKKKYLPKTYMFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLFDNREKYNVPLVSDDYLANHAPKPVSDIAAEITAEAKLKNVSVKKNKSKFFNTFTLQGTYTGTAAKGEYEDWKIITQNVNDTLKRLSAKEWTGYKTVTAYFVNYRVNASGQFEYDVVFHGINTEEDAENKAPVAVINGPYSGNVNEAISFKSDASKDEDGKITSYKWEFGDGTVSNEQNPTHVYTKEGAYTAKLTVTDDKGATNTATATVTVQKKEDNSLEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGETGNYTVEVK

SEQ ID NO: 334 - protein, 971 aa, Bacillus Sp.
MKGYSKKVLVGVSFASLMLGSFQGGALAEGTKGEQVSYRNVLKMEPVGVQLPVQELAHSSKVLENKSFEKRLQFADLSQRPPEVKKESKQLAVAKTYTIAELNQLSNQQLVDLLVTINWEQITGLFQFNKDSLAFYQNDSRIQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALIGTVTAKNGWLINNGIYYTGRLGTFHGTGTKGLQVVTDAMKIYPYLGEQYFVAAEQIATNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPADRYTAERTLNAKYGTWDFYNYSFALQSYMYNKRYDMFDKIHDLIRKNDVTAYDAYRSALSKDANLNKEYQDYMQMLVDNREKYNVPLVSDDYLATHAPKPVSDIAAEITAEAKLNNVSVKKNKSQFFHTFTLQGTYTGTTAKGEYEDWKTITQNVNDTLKRLSAKEWTGYKTVTAYFVNYRVNTSGQFEYDVVFHGINTEEGAVNKAPVAVINGPYIGNISEAISFKSDGSKDEDGKIVSYKWEFGDGTVSNEQNPTHVYTKEGTYTAKLTVTDDKGLTNTVTTNVTVQKKEDNSIEKEPNNSFQTANKLQFNQVLRASLGNGDTSDFFEINVETAKNLQINVTKENNIGVNWVLYSEADLNNYITYAQQEGNKLVGSYYTYPGKYYLHVYQYGGGTGNYTVEVK

SEQ ID NO: 335 - protein, 971 aa, Bacillus Sp.
MKGYSKKVLVGVSFASLMLGSFQGGALAEGTKGEQASYRNVLKMEPVGVQLPVQELAHSSKVLENKSFEKRLQFADLSQRPPELKKESKQLATAKTYTIAELNQLSNQQLVDLLVTIDWEQITGLFQFNKDSLAFYQNDSRIQAIIDKLKQQGQDYTKDDSKGIETLVEVLRSGFYLGFYHTELSKLNERSYHDKCLPALKTIANNANFKLGTLEQNRVVSSYGKLIGNASSDVETITSAAKIFKQYNDNFSTWVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGTIVLKAGDKVTEEKVKRLYWAAKEVKAQFHRTVESDQPLEKGNADDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSALSKDANLNKEYQDYMQMLVDNRDKYNVPLVSDDYLATHAPKPVSDIVAEITAEAKLSNVSVKKNKSQFFHTFTLQGTYTGTTAKGEYEDWKSITQNVNDTLKRLSAKEWTGYKTVTAYFVNYRVNASGQFEYDVVFHGMNTEEGAVNKAPVAVINGPYSGNVNEAISFKSDGSKDEDGKIVAYKWEFGDGTVSNEQNPTHVYTKEGTYTARLTVTDDKGLTNTVTTNVTVQKKEDNSVEKEPNNSFQTANTLQFNQVLRASLGNGDTSDFFEINVETAKNLQINVTKENNIGVNWILYSEADLNNYITYAQQEGNKLVGSYYTYPGKYYLHVYQYGGGFGNYTVEVK

SEQ ID NO: 336 - protein, 971 aa, Bacillus Sp.
MKGYSKKVLVGVSFASLMLSSFPGTILAEDTKEEQVSYRNVLKMEPVGVQLPVQELAHSSKVLENKSFEKRLQFADLSQRPPEVQKESKQLAAAKTYTIAELNQLSNQALVDLLVTIDWEQITGLFQFNKDSLAFYQNDSRMQAIIDKLKQQGQAYTKDDSKGIETLVEVLRSGFYLGFYHTELSKLNERSYHDKCLPALKSISQNPNFKLGTLEQNKVVSSYGKLIGNASSDAETISSVANIFKQYNDNLSTFIDNRSAGNAVYDIMQGVDYDIQSYLYDTNKAPKDTMWYQKIDSYINELSRFALIGTVTAKNGWLINNGIYYTGRLGTFHSTGTKGLQVVTDAMKVYPYLGEQYFVAAEQITTNYGGKDANGNVVDLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGIYIEGTGTFFTYERTPQESIYSLEELFRHEFTHYLQGRYEVPGLWGQGKLYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSALSKDANLNKEYQDYMQMLVDNREKYNIPLVSDDYLATHAPKPVSDIAAEITAEAKLSNVSVKKNKSQFFNTFTLQGTHTGTAAKGENEDWKTITQNVNDTLKRLSAKEWTGYKTVTAYFVNYRVNASGQFEYDVVFHGINTEEGAVNKAPVAVINGPYSGNVNEAISFKSDGSKDEDGKITSYKWEFGDGTVSSEKNPTHVYTKEGTYTAKLTVTDDKGAANTNTTSVTVQKKEDNSVEKESNNTFKTANKLQLNQLLRASLGNGDTSDYFEINVETAKNLQINVTKENNIGVNWVLYSEADLNNYVTYAQQQGNKLVGSYYTHPGKYYLHVYQYGGGTGNYTVEVK

SEQ ID NO: 337 - protein, 971 aa, Bacillus Sp.
MKGYSKKVLVGVSFASLMLSSFPGNILAEDTKEEQVSYRNVLKMEPVGVQLPVQELAHSSKVLENKSFEKRLQFADLSQRPPEVQKESKQLAAAKTYTIAELNQLSNQALVDLLVTIDWEQITGLFQFNKDSLAFYQNDSRMQAIIDKLKQQGQAYTKDDSKGIETLVEVLRSGFYLGFYHTELSKLNERSYHDKCLPALKTIAQNPDFKLGTLEQNKVVSLYGKLIGNASSDAETVTSAANIFKQYNDNLSIFIDNRSVGNAVYDIMQGVDYDIQSYLYDTEKAPKDTLWYQKIDSYINELSRFALIGTVTAKNGWLINNGIYYIGRLGTFHSTGTKGLQVVTDTMKLYPYLGEQYFVAAEQITTNYGGKDANGKVVDLDQIREEAKKKYLPKTYTFDDGTIVLKAGDKVTEEKVKRLYWAAKEVKAQFHRTVESDQPLEKGNPDDVLTMVIYNSPAEYQFNRQLYGYETNNGGIYIEGTGTFFTYERTPGESIYSLEELFRHEFTHYLQGRYEVPGLWGQGKLYENERLSWFEEGNAEFFAGATRTDNVVPRKSMIGGLSSNPAERYTAERTLNAKYGTWDFYNYSFALQSYMYNKRYDMFDKIHDLIRKNDVTAYDAYRSALSKDANLNKEYQDYMQMLVDNRDKYNVPLVSDDYVATHAPKPVSDIAAEITAEAKLKNVSVKKNKSQFFNTFTLQGTYTGTAAKGENEDWKTITQNVNDTLKRLSAKEWTGYKTVTAYFVNYRVNASGQFEYDVVFHGINTEEGAENKAPVSVINGPYSGNVNEATSFKSDGSKDEDGKIASYKWEFGDDTVSSEQNPTHVYTKEGTYTAKLTVTDDKGAANTNTTSVTVQKKEDNSVEKESNNTFKTANKLQLNQLLRASLGNGDTSDYFEINVETAKNLQINVTKENNIGVNWVLYSEADLNNYVTYAQQQGNKLVGSYYTHPGKYYLHVYQYGGGTGNYTVEVK

SEQ ID NO: 338 - protein, 1004 aa, Bacillus Sp.
MCERSLIFSQYRIKSKNSKIMVRDTKKCKVGESMKGYSKKVLVGVSFASLMLGSFQGSTLAESKKGEQVSYRNVLKMEPVGVQLPVQELAHSSKVLENKSFEKRLQFADLSQRPPEVKKESKQLAAAKTYTIAELNQLSNQQLVDLLVTIDWEQITGLFQFNKDSLAFYQNDSRMQAIIDKLKQQGQVYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALIGTVTEKNGWLINNGIYYTGRLGTFHSTGTKGLQVVTDAMKMYPYLGEQYFVAAEQIATNYGGKDANGNVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKMYENERLSWFEEGNAEFFAGATRTDNVVPRKSIIGGISSNPAERYTAERTLNAKYGTWDFYNYSFALQSYMYNKRYDMFDKVHDLIRKNDVTAYDAYRSTLSKDANLNKEYQDYMQMLVDNREKFNVPLVSDDYLATHVPKPVSDIAAEITAEAKLSNVSVKKNKSQFFNTFTLQGTYTGTTAKGEYEDWKTITQNVNDTLKRLSAKEWTGYKTVTAYFVNYRVNASGQFEYDIVFHGMNTEEGAVNKAPVAIINGPYSGNVNAAISFKSDGSKDEDGKIVAYKWEFGDGTVSNEQNPTHVYTTEGTYTAKLTVTDDKGLTNTVTTNVTVQKKEDNSVEKEPNNSFQTANKLQLNQVLRASLGNGDTSDYFEINIETAKNLQINVTKENNIGVNWVLYSEADLNNYVTYAQQEGNKLVGSYYTYPGKYYLHVYQYGGGTGNYTVEVK

SEQ ID NO: 339 - protein, 1004 aa, Bacillus Sp.
MCERSLIFSQYRINSQNSKMMERDTKKCKVGESMKGYSKKVLVGVSFVSLMLGSFQGNISAEDTKGEQVSYRNVLKMEPVGVQLPVQELAHSSKVLENKSFEKRLQFADLSQRPPEVQKESKQLAAAKTYTIAELNQLSNQALVDLLVTIDWEQITGLFQFNKDSLAFYQNDSRMQAIIDKLKQQGQAYTKDDSKGIETLVEVLRSGFYLGFYHTELSKLNERSYHDKCLPALKTIAQNPDFKLGTLEQNKVVSLYGKLIGNASSDAETVTSAANIFKQYNDNLSTFIDNRSAGNAVYDIMQGVDYDIQSYLYDTEKAPKDTMWYQKIDSYINELSRFALIGTVTAKNGWLINNGIYYTGRLGTFHSTGTKGLQVVTDAMKLYPYLGEQYFVAAEQITTNYSGKDANGKVVDLDQIREEAKKKYLPKTYTFDDGAIVLKAGDKVTEEKVKRLYWAAKEVKAQFHRTVESDQPLEKGNPDDVLTMVIYNSPAEYQFNRQLYGYETNNGGIYIEGTGTFFTYERTPQESIYSLEELFRHEFTHYLQGRYEVPGFWGQGKFYENERLSWFEEGNAEFFAGATRTDNVVPRKSMIGGLSSNPAERYTAERTLNAKYGTWDFYNYSFALQSYMYNKRYDMFDKIHDLIRKNDVTAYDAYRSALSKDANLNKEYQDYMQMLVDNRDKYNVPLVSDDYVATHAPKPVSDIAAEITVEAKLSNVSVKKNKSQFFNTFTLQGTYTGTAAKGEYEDWKTITQNVNDTLKRLSAKEWTGYKTVTAYFVNYRVNASGQFEYDVVFHGINTEEGTENKAPVAVINGPYNGNVNEAISFKSDGSKDEDGKIASYKWEFGDGTVSNEQNPTHVYTKEGTYTAKLTVTDDKGATNTNTTSVTVQKKEDNSIEKEPNNSFQTANKLQLNQVLRASLGNGDTSDYFEINVETAKNLQINVTKENNIGVNWVLYSEADLNNYVTYAQPQGNKLVGSYYTYPGKYYLHVYQYGGGTGNYTVEVK

SEQ ID NO: 340 - protein, 972 aa, Bacillus Sp.
MRDYSKKVLAGVSLITFMLGSFQGEALAKDNKNDKAHSYRNVLRMEPTGVQLPLQELAHSSNVLENKSFEKRLQLSDLSQRPPEVMKETKQEAPAKKYTIAELNQLSNQQLVDLLVTINWEQISGLFQFNNDSLAFYQNDSRMQAIIDKLAQQGKTYTKDDSKGIETLVEVLRSGFYLGFYHNELSKLNERSYHDKCLPALKLIAKNPNFKLGTSEQDRVVSSYGKLIGNASSDPEIVSLATPIFKQYNDNLPTYVDSRSAGSAVYDIMQGIDYDIQSYLYDTRKEPKDTMWYKKIDGYINELSRFALIGTVTDKNGWLINNGLYYTGRLGMFHTTSTKGLQVVTEAMKVYPYLSEQYFVAAEQITTNYGGKDANGKTIDLDQIREDGKKKYLPKTYTFDDGAIVLKAGDKVTEEKVKRLYWAAKEVKAQFHRTVESDKPLENGNPDDVLTMVIYNSPAEYQFNRQLYGYETNNGGLYIEGTGTFFTYERTPEESIYSLEELFRHEFTHYLQGRYEVPGLWGEGKIYEDERLSWFEEGNAEFFAGSTRTDNVVPRKSIIGGLSSNPADRYTAEQTLNAKYGTWDFYNYSFALQSYMYNKRYDMFDKIHDLIRKNDVSGYDAYRLALSKDSGLNKEYQDYMQMLVDNRDKYNVPLVSDNYLAKHALKPVSDIEADITAEAKLKDVKVTKHKSQFFNTFTLQGTYTGGTAKGEYEDWKTIIQTVNDSLKRLAEKEWTGYKTVTAYFVNYRVNASGQFEYDLVFHGINTEESTGNKAPVAVINGPYSGNVNEAISFKSDGSKDEDGKIAAYKWEFGDGQLSNEKNPSHVYTKEGTYTVKLSVTDDKGATATATTNVTVQKKDTGSVEAEPNNSFETANKLSLNKLLRGSLSDGDENDFFEINVETAKNLQINVTNENNLGMNWVLYSEADLNNYITYAQREGNKLVGNYYTYPGKYYLHVYKYSGGSGNYTVEVK

SEQ ID NO: 341 - protein, 972 aa, Bacillus Sp.
MRGYSKKLLTGVSLIAFMLGSFQGEVLAKDDKKENTHSYRNVLRMEPSGERVPLQELAHSSNVLENKSFEKRLQLADLSQRPPEAMKEAKQAVPAKKYTIAELNQLSNQNLVDLLVTINWEQISGLFQFNNDSLAFYQNDSRMQAIIDKLAQQGQTYTKDDSKGIETLVEVLRSGFYLGFYHNELSKLYERSYRDKCLPALKAIAKNPNFKLGTSEQNKVVSLYGKLIGNASSDAEIISLAAPIFKQFNDNLSTYVGSRSAGSAVYDLMQGIDYDIQSYLYDTEKGPKDTMWYRKIDSYINELSRFALIGTVTDQNGWLINNGLYYTGRLGMFHSTPTKGLQVVTEALKVYPYLSEQYFVAAEQITTNYGGKDANGKVIDLDQIREDGKKKYLPKTYTFDDGAIVLKAGDKVTEEKVKRLYWAAKEVKAQFHRTVESDKSLEQGNPDDVLTMVIYNSPEEYQFNRQLYGYETNNGGIYIEGTGTFFTYERTPEESIYSLEELFRHEFTHYLQGRYEVPGLWGQGKFYENERLSWFEEGNAEFFAGATRTDNVVPRKSIIGGLSSNPADRYTAEKTLNAKYGTWDFYNYSFALQSYMYNKRYDMFDKIHDLIRKNDVQGYDAYRSALSKDQGLNKEYQDYMQMLIDNREKYNVPLVSDDYLANHAPKPVSDIASDITAEARLKDVKVTKHKSQFFNTFTLQGTYTGDAAKGEYEDWKTITKTVNDSLKRLSAKEWTGYKTLTAYFVNYRVNASGQMEYDVVFHGINTEGNTENKAPIAVVNGPYTGNVNESISFKSDGSKDEDGQILSYKWEFGDGQTSGEKNPSHVYTKEGTYTAKLTVTDDKGVSTSVTTSVTVQKKDTGSVETEPNNSFKTANKITLNQLLRASLSDADNNDFFEINVETAKNLQISVTKENNIGVNWVLYSAADLNNYITYAQPEGNKLVGSYYTYPGKYYLHVYKYSGGSGNYTVEVK

SEQ ID NO: 342 - protein, 838 aa, Bacillus Sp.
MLYQNDSRMQAIIDKLNQQGQAYTKDDSKGIETLVEVLRSGFYLGFYHTELSKLNERSYHDKCLPALKTIANNPNFKLGTLEQNRVVSSYGKLIGNASSDVETITSAAKIFKQYNDNFSTLVDNLSAGNAIYDIMQGVDYDIQSYLYDTRKAPKDTIWYQKIDSYINELSRSALIGTVTAKNGWLINNGIYYTGRLGTFHSTETKGLQVVTDAMKIYPYLGEQYFVAAEQIATNYGGKDANGKVVDLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVLGLWGQGKMYENERLSWFEEGNAEFFAGATRTDNVVPRKSIIGGISSNPAERYTAERTLNAKYGTWDFYNYSFALQSYMYNKRYDMFDKIHDLIRKNDVTAYDAYRSALSKDANLNKEYQDYMQMLVDNREKYNVPLVSDDYLATHAPKPVSDIAAEITAEAKLSNVSVKKNKSQFFHTFTLQGTYTGTTAKGEYEDWKSITQNVNDTLKRLSAKEWTGYKTVTAYFVNYRVNASGQFEYDVVFHGINTEEGAVNKVPVAVINGPYSGNVNEAISFKSDGSKDEDGKITSYKWEFGDGAVSNEQNPTHVYTKEGTYTAKLTVTDDKGLTNTVTTNVTVQKKEDNSVEKEPNNSFQTANKLQLNQILRASLGNGDTSDYFEMNVETAKNLQINVTKENNIGVNWVLYSEADLNNYVTYAQQEGNKLVGSYYTYPGKYYLHVYQYGGGTGNYTVEVK

SEQ ID NO: 343 - protein, 789 aa, Bacillus Sp.
MFWEEKEMKLKRGLLFICTSTMLAIPSMASAKNNDVPFYNGQNDSFLTSLNLQLPGKYYRPGSGYAAKESLYRADVHFPAVYNGSFNWDNPRENLVQAEDTSEPYIRIANEGYLNSKVPAGDRMVTEVERVNNSVISSKYWGNPEFVLENMDKHMIQTYESFRELGQFYWIRDIAYLSGGYAGASGVGNINKYSLWYVRTSKPQVKDFQAMSGKKDIPVKFTFKGFEYVSKNKGYNDRDPNGTTVNPYQKAAGERNRVKWMLDITKDGETVYHQENYLRSTPQKDNQKPNEGDAGQFKKEDITWQPQLCGQYTAKIKVLDAVQRESNEKAVDFTIDGNCGTEVTPNPDPGDEDDFKYKIDFSADRIEGETAREGKNIKTRVDVSRDNFKLERDQYRAKVNNNINKSQQEINSTESDRDSAQSSLSYCRRNPIHEVDAEGKDHYYDRDCSWEENKLDSAASKLDNARQKLEKEKNKIKKLDVLEEKYMNPETVVVLKHNGQQVALQKVRLTEGEKKTLNLDWQHKGKGTIQAEINPAGNRIDIEETTYKNNPIKTAIYEPSKEKAMCGVTSVKGVVETVSERVSKEDITGAMYYETLTGSIGNLAPSKLHSGYGFSYEVNGKYKNDWNANYPGVFTAAKAQYPFADEGLKSTQDLEKKELKDTTAKFLPKNMYLSEATGHVFDSKRPTKSLYWDGQEKIIDGGQKWYSPLKTKNGVYTFNVETAPAGINEMSLCLTEQVEIKGVAYDDFIKRRVFPDDPFPGGSGVGWNWVGKEDVLYKLTDWYYMRNRK

SEQ ID NO: 344 - protein, 782 aa, Bacillus Sp.
MKLKRGLLFICTSTMLAIPSMASAKNNDVPFYNGQNDSFLTSLNLQLPGKYYRPGSGYAAKESLYRADVHFPAVYNGSFNWDNPRENLVQAEDTSEPYIRIANEGYLNSKVPAGDRMVTEVERVNNSVISSKYWGNPEFVLENMDKHMIQTYESFRELGQFYWIRDIAYLSGGYAGASGVGNINKYSLWYVRTSKPQVKDFQAMSGKKDIPVKFTFKGFEYVSKNKGYNDRDPNGTTVNPYQKAAGERNRVKWMLDITKDGETVYHQENYLRSTPQKDNQKPNEGDAGQFKKEDITWQPQLCGQYTAKIKVLDAVQRESNEKAVDFTIDGNCGTEVTPNPDPGDEDDFKYKIDFSADRIEGETAREGKNIKTRVDVSRDNFKLERDQYRAKVNNNINKSQQEINSTESDRDSAQSSLSYCRRNPIHEVDAEGKDHYYDRDCSWEENKLDSAASKLDNARQKLEKEKNKIKKLDVLEEKYTNPETVVVLKHNGQQVALQKVRLTEGEKKTLNLDWQHKGKGTIQAEINPAGNRIDIEETTYKNNPIKTAIYEPSKEKAMCGVTSVKGVVETVSERVSKEDITGEMYYETLTGSIDNLAPSKLHSGYGFSYEVNGKYKNDWNANYPGVFAAAKAQYPFADEGLKATQDLEKKELKDNTAKFLPKNMYLSEATGHVFDSKRPTKSLYWDGQEKIIDGGQKWYSPLKTKDGVYTFNVETAPAGINEMSLCLTEQVEIKGVAYDDFIKRRVFPDDPFPGGSGVGWNWVGKEELLHKLTDWYYMKTGK

SEQ ID NO: 345 - protein, 789 aa, Bacillus Sp.
MFQEEKKMKLKRGLLFICTSTMLAIPSIASAKNNDVPFYNGQNDSFLTSLNLQLPGKYYRPGSGYAAKESLYRADVHFPAVYNGSFNWENPRENLVQADDTSEPYIRIANEGYLNGKVPAGDRMVTEVERVNNSVISSKYWGNPEFVLDNIDKHMIQTYESYRELGQFYWIRDIAYLAGGYAGAGGVEGVNRYSLWYVRTSKPEIKDFKAKSGKKDVPVKFTFSGFEYVSKNKGYNDRDPNGTTVNPYQKAAGERNRVKWMLDIIKDGETVHHQENYLRSNPQKDNERANEGDAGKFVKDDVKWQPQMCGRYTAKIKVLDAVQRESNEKNVDFTIDGNCGTEVTPNPDPGDEDDFKYKIDFSADRIEGETAREGKNIKTRVDVSRDNFKPERDQYRTKVNNNINKSQQEINSAESDRDSAQSSLSYCRRNPIHEVDAEGKDHYYDRDCSWEENKLDSAASKLDNARQKFEKEKNKLKKLDVLEEKYTNPETVVVLKHNGQQVSSQKVRLTEGEKKTLNLDWQHKGKGTIQAEINPAGNRIDIEETTYKNNPIKTAIYEPSKEKAMCGVTSVKGVVETVSERVSKEDIVGKMYYETLTGSIDNLAPSKLHSGYGFSYEVNGKYKNEWNANYPGVFAAAKAQYPFADEGLKATQDLEKIELKDNTAKFLPKNMYLSEATGHVFDSKRPTKSLYWDGQEKIIDGGQKWYSPLKTKDGVYTFNVETAPAGINEMSLCLTGQVEIKGVAYDDFIKRRVFPDDPFPGGSGVGWNWVGKEELLHKLTDWYYMKTGK

SEQ ID NO: 346 - protein, 767 aa, Bacillus Sp.
MVWPSVASANNGDIPFYNGNEDTSVKSPELQLNGKLLRPGRGYKSKEFNYKADLHFPAVYNGSFNWGNSRENLIQNEDHSEPFVRISNDGYINPSVTVGDRMVTEMERITNDIIASKYWGNPEFVLRNIVPHRIKNEFSDKSYGEFYWIRDIAYLSGGYAGAGGVNDVNRYSLWYVRTSKPQIKDFKATSGKKDIPVKFTFNGFEYVSKNKGYNDRDPNGTTVNPYQRAAGERNRVKWILDIIKDGETVHHQENYLRSTPQKDNQKPNEGDAGQFKSEELKWQPQMCGRYTAKIKVLDAVQRESNEKTVDFTIDGNCGTEVTPNPDPGDEDDFKYKIDFSADRIEGETAREGKNIKTRVDVSRDNFKLERDQYRAKVNNNINKSQQEVNSSESERDSAQSSLSYCRRNPIHEVDAEGKDHYIDRDCSWEENRLDSAASKLDNARQKLEKEKNKIKKLDVLEEKYTNPETVVVLKHNGQQVALQKVRLTEGEKKTLNLDWQHKGKGTIQAEINPAGNRIDIEETTYKNNPIKTAIYEPSKEKAMCGVTSVKGVVETVSERVSKEDITGEMYYETLTGSIGNLAPSKLHSGYGFSYEVNGKYKNDWNANYPGVFTAAKAQYPFADEGLKSTQDLEKKELKDTTAKFLPKNMYLSEATGHVFDSKRPTKSLYWDGQEKIIDGGQKWYSPLKTKDGVYTFNVETAPAGINEMSLCLTEQVEIKGVAYDDFIKRRVFPDDPFPGGSGVGWNWVGKEDVLYKLTDWYYMRNRK

SEQ ID NO: 347 - protein, 784 aa, Bacillus Sp.
MKLKRSLLLLCTSTALMIPSIASAKNADVPFYNGTNDTSLTSRKLQMTGKFYRFGSNYAPPGIDLAYKGDLHYPAVYNGSFSFENPQANLVQREDLSEPYVRISNEGYWNSAIAVGDRMITEKERITESIISDKYWGNSQFVLNNIDSHTVSNGNSPKSYGLFYWIRDIAYLSGGYAGAGGVNGINKYSLWYVRTSKPKIKDFKVSSGKKDTPVKFTFNGFEYVSKEKGYTERGPKLDIGNPYSSIAGERNRVQWLLDITKSGETVHHQENYLRSTPQKDNQKPNEGDAGRFTKEDIRWQPQMCGRYTAKLKIIDGVQRGSNEKTVDFIVDGNCGTEVTPNPDPGDEDDFKYKIDFSADRIEGETAREGKNIKTRVDVSRDNFKLERDQYRAKVNNNINKSQQEINSTESDRDSAQSSLSYCRRNPIHEVDAEGKDHYYDRDCSWEENKLDSAASRLDNARQKLEKEKNKIKKLDVLEEKYMNPETVVVLKHNGQQVALQKVRLTEGEKKTLNLDWQHKGKGTIQAEINPAGNRIDIEETTYKNNPIKTAIYEPSKEKAMCGVTSVKGVVETVSERVSKEDITGEMYYEILTGSIGNLAPSKLHSGYGFSYEVNGKYKNDWNANYPGVFTAAKAQYPFADEGLKSTQDLEKKELKDTTAKFLPKNMYLSEATGHVFDSKRPTKSLYWDGQEKIIDGGQKWYSPLKTKDGVYTFNVETAPAGINEMSLCLTEQVEIKGAAYDDFIKRRVFPDDPFPGGSGVGWNWVGKEDVLYKLTDWYYMRNRK

SEQ ID NO: 348 - protein, 767 aa, Bacillus Sp.
MLLPSVASAGNSDVPFYNGNETTILASDELQLKGKLLRSGSRYKPKEFEYKADIHFPAVYNGSFNWGNPRENLIHNEDQSEPYVRISNDGYINPSVVVGDRMVTEVERITNSIITDKYWGNSQFVLKYLIPHKITNQDSFESYGHFYWIRDIAYLSGGYAGAGSVNGVNRYNLWYVRTSKPEIKDFKATSGKKDVPVKFTFNGFEYVSKNKGYNDRDPNGTTVNPYQAAAGERNRVKWMLDITKDGETVYHQENYLRSTPQKDNQKPNEGDAGQFKSEELKWQPQMCGRYTAKIKVIDAVQRESNEKTVDFTINGNCGTEVTPNPDPGDDDDFKYKIDFSADRIEGETAREGKNIKTRIDVSRDNFKPERDQYRAKVNNNINKSQQEVNSSESERDSAQSSLSYCRRNPIHEVDAEGKDHYYDRDCSWEENKLDSAASKLDNARQKLEKEKNKIKKLDVLEEKYTNPETVVVLKHNGQQVALQKVRLTEGEKKTLNLDWQHKGKGTIQAEINPAGNRIDIEETTYKNNPIKTAIYEPSKEKAMCGVTSVKGVVETVSERVSKEDITGEMYYETLTGSIDNLAPSKLHSGYGFSYEVNGKYKNDWNANYPGVFAAAKAQYPFADEGLKATQDLEKKELKDNTAKFLPKNMYLSEATGHVFDSKRPTKSLYWDGQEKIIDGGQKWYSPLKTKDGVYTFNVETAPAGINEMSLCLTEQVEIKGVAYDDFIKRRVFPDDPFPGGSGVGWNWVGKEELLHKLTDWYYMKTGK

SEQ ID NO: 349 - protein, 783 aa, Bacillus Sp.
MKLKRNLLLTLCTSTVLMLPSIANAKNIDIPFYNGEDNTFLTSSDLQMPGKFFRPGGGFEPVKTLYKADIHYPAVYNGAFNWGNPKENLVKNEDNTEPFVRIANEGYFNDKVPVGDRMVTEVERVNASVIKDKYWGNPDFVLKSMLPHEITGFRDFKSFGMFYWIRDIAYLSGGYAGAGAVEGVNKYNLWYVRTNKPELKDFKASSSTKDVAVKFTFNGFEYVSKNKGYNDRDPNGTTVNPYQAAAGERNRVKWMLDITKDGETVHHQENYLRSTPQKDNEKSNEGDAGKFVKDDVKWQPQMCGRYTAKIKVLDAVQRESNEKNVDFTIDGNCGTEVTPNPDPGDEDDFKYKIDFSSDRIEGETAREGKNIKTRVDVSRDNFKPERDQYRVKVNNNINKSQQEINSSESERDSAQSSLSYCRRNPIHEVDAEGKDHYYDRDCSWEENKLDSAASKLDNARQKFEKEKNKLKKLDVLEEKYTNPETVVVLKHNGQQVSTQKVRLTEGEKKTLNLDWQHKGKGTIQAEINPAGNRIDIEETTYKNNPIKTAIYAPSHEKGMCGVTSVKGVVETVSERVTKEDTVGEMFYETLSGSIDNLAPSKLHSGYGFSYEVNGKYKNDWNENYPGVFAAAKAQYPFADEGLKSTQDLDKKELKDNTAKFLPKNMYMSESTGHVFDSKRPTKSLYWDGQEKIIDGGQKWYSPLKTKDGVYTFNVETAPAGINEMSLCLTGQVEIKGVAYDDFIKRRVFPDDPFPGGSGVGWNWVGNEELLHKLTDWYYMKTGK

SEQ ID NO: 350 - protein, 784 aa, Bacillus Sp.
MKLKRSLLLLCTSTALMIPSIASAKNADVPFYNGTNDTSLTSRKLQMTGKFYRFGSNYAPPGIDLAYKGDLHYPAVYNGSFSFENPQANLVQREDLSEPYVRISNEGYWNSAIVVGDRMITEKERITESIISDKYWGNSQFVLNNIDSHTVSNGNSPKSYGLFYWIRDIAYLSGGYAGAGGVNGINKYSLWYVRTSKPEIKDFKVSSGKKDTPVKFTFNGFEYVSKEKGYTERGPKLDIGNPYSSIAGERNRVQWLLYITKSGETVHHQENYLRSTPQKDNQKPNEGDAGKFTKEDISWQPQMCGRYTAKLKIVDGVQRGSNEKTVDFIVDGNCGTEVTPNPDPGDEDDFKYKIDFSADRIEGETAREGKNIKTRVDVSRDNFKPERDQYREKVNNNINNSQQEVNSSESERDSAQSSLSYCRRNPIHEVDAEGKDHYIYRDCSWEENRLDSAVSKLDNARQKLEKEKNKIKKLDVLEEKYTNPETVVVLKHNGQQVALQKVRLTEGEKKTLNLDWQHKGKGTIQAEINPAGNRIDIEETTYKNNPIKTAIYEPSKEKAMCGVTSVKGVVETVSERVSKEDITGEMYYETLTGSIDNLAPSKLHSGYGFSYEVNGKYKNDWNANYPGVFAAAKAQYPFADEGLKATQDLEKKELKDNTAKFLPKNMYLSEATGHVFDSKRPTKSLYWDGQEKIIDGGQKWYSPLKTKDGVYTFNVETAPAGINEMSLCLTEQVEIKGVAYDDFIKRRVFPDDPFPGGSGVGWNWVGKEELLHKLTDWYYMKTGK

SEQ ID NO: 351 - protein, 781 aa, Bacillus Sp.
MKLKRNLLLTLCTSTMLMVPTIASAKNADIPFYNGNDDTFISSQLQMPGKYFRPGSGFDPVKTLYKADIHYPAVYNGSFNWDNPRQNLVQSEDSSEPFVRIANEGYFNNSVPVGDRMVTEIERVNASVIKDKYWGNTDFVLKNIIPNKISGAVDLKSFGEFYWIRDMAYLSGGYAGAGAVEGVNKYSLWYVRTSKPEIKDFKAKSGKKDVPVKFTFNGFEYVSKNKGYNDRDPNGTTVNPYQKAAGERNRVKWMLDITKDGETVYHQENYLRSTPQKDNQKPNEGDAGQFKSEELKWQPQMCGRYTAKIKVLDAVQRESNEKTVDFTIDGNCGTEVTPHPDPGDEDDFKYKIDFSADRIEGETAREGKDIKTRVDVSRDNFKPERDQYRAKVNNNINKSQQEINSAESDRDSAQSSLSYCRRNPIHEVDAEGKDHYYDRDCSWEENKLDNAASKLDNARQKLEKEKNKIKKLDVLEEKYTNPETVVVLKHNGQQVALQKVRLTEGEKKTLNLDWQHKGKGTIQAEINPAGNRLDIEETTYKNNPIKTAIYEPSREKAMCGVTSVKGVVETVSERVSEEDTAGEMFYETLSGSIDNLSPSKLHSGYGFSYQVNGTYKNQWNENYPGVFTAATAQYPFADEGLKTTQDLEAISNTGLASRFQPKNMYMSEITGHVFDSKRPTKSLYWDGQEKIIDGQRKWYAPLKTKDGKYAFNVETKPAGVNEMSLCLTSEVEIKGVAYDDFKKRRVLADLPFPVQTPGWNWVGKEHIITDLSNWYYMKNRK

SEQ ID NO: 352 - protein, 738 aa, Bacillus Sp.
MKLRKRVLLTCTSLMLALPSVASAANNNIPFFDGSENSLLKSDELQLKGKLLRPGSGYKSKEFDYKADLHFPAVYNGSFNWGNPWENLVQNEDTSDPYVRISNDGYINSAVVVGDRMVTEVEQVTKTVVKDKYWGQPDFVLTNMAKHKIIKFKGSNDSLGSFYWIRDIAYLSGGYAGAGGVNGVNRYSLWYVRTSKPQIKDFKATSGKKDIPVKFTFNGFEYVSKNKGYNDRDPNGTTINPYQKAAGERNRVKWMLDITKDGETVYHQENYLRSTPQKDNQKPNEGDAGQFKSEELKWQPQMCGRYTAKIKVLDAVQRESNEKKVDFNIDGNCGTEVTPNPDPGDEDDFKYKIDFSADRIEGETAREGKNIKTRVDVSRDNFKSDRDQYRAKVNNNINKSQQEVNSSESERDSAQSSLSYCRRNPIHELDAEGKDHYYDRDCSWEENKLDSAASKLDNAKQKFEKEKNKLKKLDVLEEKYTNPETVVVLKYNGQQVSSQKVRLTEGEKKTLNLDWQHKGKGTIQAEINPAGNRIDIEETTYKNNPIKTAIYEPSKEKAMCGVTSVKGVVETVSERVSKEDIVGKMYYETLTGSIDNLAPSKLHSGYGFSYEVNGKYKNDWNANYPGIFTAAKAQYPFADEGLKSTQDLEKNELKDNTAKFLPKNMYLSESTGHVFDSKRPTKSLYWDGQEKIIDGGQKWYSPLKTKDGVYTFNVETAPAGINEMSLCLTEQVEIKGVA

SEQ ID NO: 353 - protein, 781 aa, Bacillus Sp.
MKLKKNILLTCTSLILLLPSVASAGNSDVPFYDGNETTILASDELQLKGKLLRPGSSYKPKEFAYKADIHFPAVYNGSFNWGNPRENLIQNEDQSEPYVRISNDGYINPSVVVGDRMVTEVERITNSIITEKYWGNSQFVLKYLIPHKITNQDSFESYGHFYWIRDIAYLSGGYAGAGGVNDVNRYSLWYVRTSKPQIKDFKATSGKKDIPLKFTFNGFEYVSKNKGYNDRDPNGTTINPYQKAAGERNRVKWMLDITKDGETVYHQENYLRSTPQKDNQKPNEGDAGQFKSEELKWQPQMCGRYTAKIKVLDAVQRESNEKTVDFTIDDNCGTEVIPNPDPGDEDDFKYKIDFSSDRIEGETAREGKNIKTRIDVSRDNFKPERDQYREKVNNNINKSQQEGNSSESDRDSAQSSLSYCRRNPIHEVDAEGNHHYYDRDCSWEENKLDSAASRLDNARKKLEKEKNKIKKLDVLEEKYTNPETVVVLKHNGQQVASQKVRLTEGEKKTLNLGWQHKGKGTIQAEINPTGDRLDIAETTYKNNPIKTAIYAPSHEKGMCGVTSVKGVVETVSERVSKEDTVGEMFYETLSGSIDNLAPSKLHAGYGFSYELNGKYKNDWNANYPGVFTKAMAQYPFADEGLKTTNDLESVSNNGLTSKFLPENMYLSEVTGHVFDSKRTTKSLYWDGKEKIIDGQRKWYAPLKTKDGKYSFNVETNPAGVNEMSLCLTNEVEIKGVAYDDFKKRRVLADLPFPVQTPGWNWVGKEHIITDLSNWYYMKNRN

SEQ ID NO: 354 - protein, 1427 aa, Bacillus Sp.
MVVKRGGIRLWFRRSFSLLFVVMLLFGSLADFVSIGHAESTSDQKQAQEKKTDDVTVLQEKSDLKSTGTNPSEVVVANGKKGSELFDFEAFIKPSDIVDGTAPFDSNDEAGNDSSPNNGIVRTFDTVTYPLKVTINPKKNETLKNIKMKITGTLENGITNKRVNAKFAVGGKEDLEKGIVSFDMEYTLKETGNSLMIPVTVEVQGAEHGLKLKPNIKIQVISVDGKDIANENVSQSFDGISPVTTSGKVNVKARFTASYGGMPRLDYKVYDPNAKEDDRTIIYPVALDLFVNNLPNRTDLRGATFPAGKINYHFNFSGKVDWDYKSLGAETLNFEGRDKPIKIFNYQAIDKIVDKVPQEGTESFEIGMKGYKDPRTETANSPKSYIPKDIWNASDIDKYTIDSVWDSGTVRLNKPEITKDRVGYTGSIEDYVIGSTFPTMMSRPGYSVIPTFGKNEKAFSSTRFLIHSTNEYYPVLGKNNKDNLPNNVFYYLEFVIDSYEDGKGNTIPYNTVGRYTLTERNNPKGAYSIQTTFHTTDHKELGTPNVGYSAVSKGDPTVIVGQNVKVVSHLNVRAVTEGGTTMIYKWNTDSFYLSKNSAETARKNMLNEGYPNTSAGRVTNSDKQKIYFGISKKGDNSFETLTQNKDEDYDWYSTYDEAKKQGEVAAIKNDINASMGDGEVVAWNIPLEVKTKKIGSVNEKGTPNITVTDSIVYPSADRKVGYRVRGEGKYNNFTEYDEKGNITKLQSPVGSTVNFETLGIMNGETSSDVKTNKNTYYSSDNVSVTVDNLVKLPDAMDYNSLDEKVEMRVKIPKGLDYVVGSAKYGDQYIEPKIEQQNDGSNHLIWHDTLTRGNKTLKKINFETRINPVLLPQGNQVGLEITNVLSSAMDTRAEKFRTSSKNISVVKIGMVGVSETIEKVTGKKNSDYVVGVQPYTTIKDESHIKALTYVPRNKDHNGSAFNGVTFLRQIALENANNKNVEIWLNNSFVESNNPNKIDLKSNGWYRYTGEQDLSKVVSILLYINDSLSSSDIVKMNLVYGTHKNEFGDFYVSKTVVNTSVDYKLSPVSNQVKYTIVADANLGLRKIRIDTAPADIGLPVIVRLDKDIIYEDSNKSNVAVNLYDKSDNKLVDSKVYTIQELPEEIKFKVDPKFLKKNNKRNYEVRFEKVNKESIFIVDGKGKVDTDGYTSSEETVKANTKASTELKYKGVIMTEREVGKEMEVFYETLTIPLKQLPKQKTGYGFELKPLVSYNNELAVSYDVKTNALVDKRLIDSHLNYEKKGDQFVVPLEEAEKTGSTDKKNTDYLFELPHINVEQKTGNLFTDQQVKDHDPRIKNAIKDGKRKLYVPIWADLGEYNVLIVSGIPIGANKVNFEVTQPLNLYAYMYGTIGSKTLEDDELLLEPVDPKNPFSNGKPPGWSDVDVAWLKQ

SEQ ID NO: 355 - protein, 1418 aa, Bacillus Sp.
MWFRRSFSLLFVVMLLFGSLADFVSIGHAESTSDQKQAQEKKTDDVTVLQEKSDLKSTGINPNEVVVANGKKGSELFDFEAFIKPSDIVDGTAPFDSNDEAGNDSSPNNGIVRTFDTVTYPLKVTINPKKNETLKIIKMKITGTLENGITNKRVNAKFAVGGKEDLEKGIVSFDMEYTLKETGNSLMIPVTVEVQGAEHGLKLKPNIKIQVISVDGKDITNENVSQSFDGISPVTTSGKVNVKARFTASYGGMPRLDYKVYDPNAKEGDRTIIYPVALDLFVNNLPNRTDLRGATFPAGKINYHFNFSGKVDWDYKSLGAETLNFEGRDKPIKIFNYQAIDKIVDKVPQEGTESFEIGMKGYKDPRTETANSPKSYIPKDKWNASDIDKYTIDSVWDSGKVRLNKPEITKDRVSYTGSIEDYVVGSTFPTMMSRPGYSVIPTFGKNEKAFSSTRFLIHSTNEYYPVLGKNNKDNLPNNVFYYLEFVIDSYEDGKGNTIPYNTVGRYTLTERNNPKGAYSIQTTFHTTDHKELGTPNVGYSAVSKGDPTVIVGQNVKVVSHLNVRAVTEGGTTMIYKWNTDSFYLTKNGAETAKKNMLNEGYPNTSAGRVTNSDKQKIYFGISKKGDNSFETLTQNKDEDYDWYSTYDEARKQGEVAAIKNDINASMGDGEVVAWNIPLEVKTKKIGSVNEKGTPNITVTDSVVYPSADRKVGYRVRGEGKYNNFTEYDEKGNITKLQSPVGSTVNFETLGIMNGETSSDVKTNKNTYYSSDNVSVTVDNLVKLPDAMDYNSLDEKVEMRVKIPKGLDYVVGSAKYGDQYIEPKIEQQNDGSNHLIWHDTLTRGNKTLKKINFETRINPVLLPQGNQVGLEITNVLSSAMDTRAEKFRTSSKNISVVKIGMVGVSETIEKVTGKKNSDYVVGVQPYTTIKDESHIKALTYVPRNKDHNGSAFNGVTFLKQIALENANNKNVEIWLNNSFVESNNPNKIDLKSNGWYRYTGEQDLSKVVSILLYINDSLSSSDIVKMNLVYGTHKNEFGDFYVSKTVVNTSVDYKLSPVSNQVKYTIVADANLGLRKIRIDTAPADIGLPVIVRLDKDIIYEDSNKSNVAVNLYDKSDNKLVDSKVYTIQELPEEIKFKVDPKFLKKNNKRNYEVRFEKVNKESIFIVEGKGKVDTDGYTSSEETVKANTKASTELKYKGVIMTEREVGKEMEVFYEILTIPLKQLPKQKTGYGFELKPLVSYNNELAVSYDVKANALVDKRLIDSHLNYEKKGDQFVVPLEEAEKTGSTDKKNTDYLFELPHINVEQKTGNLFTDQQVKDHDPRIKNAIKDGKRKLYVPIWADLGEYNVLIASGIPIGANKVNFEVTQPLNLYAYMYGTIGSKTLKDDELLLEPVDPKNPFSNGKPPGWSDEDVAWLKQ

SEQ ID NO: 356 - protein, 1427 aa, Bacillus Sp.
MVVKRGGIRLWFRRSFSLLFVVMLLFGSLADFVSIGHAESTSDQKQAQEKKTDDVTVLQEKSDLKSTGTNPSEVVVANGKKGSELFDFEAFIKPSDIVDGTAPFDSNDEAGNDSSPNNGIVRTFDTVTYPLKVTINPKKNETLKNIKMKITGTLENGITNKRVNAKFAVGGKEDLEKGIVSFDMEYTLKETGNSLMIPVTVEVQGAEHGLKLKPNINIQVISVDGKDIANENVSQSFDGISPVITSGKVNVKARFTASYGGMPRLDYKVYDPNAKEDDRTIIYPVALDLFVNNLPNRTDLRGATFPAGKINYHFNFSGKVDWDYKSLGAETLNFEGRDKPIKIFNYQAIDKIVDKVPQEGTESFEIGMKGYKDPRTETANSPKSYIPKDKWNASDIDKYTIDSVWDSGKVRLNKPEITKDRVGYTGSIEDYVIGSTFPTMMSRPGYSVIPTFGKNEKAFSSTRFLIHSTNEYYPVLGKNNKENLPNNVYYYLEFVIDSYEDGKGNTIPYNTVGRYTLTERNNPKGAYSIQTTFHTTDHKELGTPNVGYSAVSKGDPTVIVGQNVKVVSHLNVRAVTEGGTTMIYKWNTDSFYLSKNGAETAKKNMLNEGYPNTSAGRVTNSDKQKIYFGISKKGDNSFETLTQNKDEDYDWYSAYDEARKNGEVAAIKNDINASMGDGEVVAWNIPLEVKTKKIGSVNEKGTPNITVTDSVVYPSADRKVGYRVRGEGKYNNFTEYDEKGNITKLQSPVGSTVNFETLGIMNGETSSDVKTNKNTYYSSDNVSVTVDNLVKLPDAMDYNSLDEKVEMRVKIPKGLDYVVGSAKYGDQYIEPKIEQQNDGSNHLIWHDTLTRGNKTLKKINFETRINPVLLPQGNQVGLEITNVLSSAMDTRAEKFRTSSKNISVVKIGMVGVSETLEKVTGKKNSDYVVGVQPYTTIKDESHIKALTYVPRNKDHNGSAFNGVTFLKQIALENANNKNVEIWLNNSFVESNNPNKIDLKSNGWYRYTGEQDLSKVVSILLYINDSLSSSDIVKMNLVYGTHKNEFGDFYVSKTVVNTSVDYKLSPVSNQVKYTIVADANLGLRKIRIDTAPADIGLPVIVRLDKDIIYEDSNKSNVAVNLYDKADNKLVDSKVYTIEELPEEIKFKVNPQFLKKNNKRNYEVRFEKVNKESIFIVDGKGKVDTDGYTSSEETVKANTKASTELKYKGVIMTEREVGKEMEIFYETLTIPLKQLPKQKTGYGFELKPLVSYNNELAVPYDVKANALVDKRLIDSHLNYEKKGDQMVVPLEEAEKTGSTDKKNTDYLFELPHINVEQKTGNLFTDQQVKDHDPRIKNAIKDGKRKLYVPIWADLGEYNVLITSGIPIGANKVNFEVTQPLNLYAYMYGTIGSKTLEDDELLLEPVDPKNPFSNGKPPGWSDVDVAWLKQ

SEQ ID NO: 357 - protein, 1417 aa, Bacillus Sp.
MWFRRSFSLLFVVMLLFGSLADFVSIGHAESTSDQKQAQENKTNDVTVLQEKSDLKSTGTNPNEVVVAKGKKGSELFDFEAFIKPSDIVDGTAPFDSNDEAGNDSSPNNGIVRTFDTVTYPLKVTINPKKNETLKNIKMKITGTLENGITNKRVNAKFAVGGKEDLEKGIVSFDMEYTLKETGNSLMIPVTLEIQGAEQGLKLKPNIKIQVISVDGKDIQDENVSQSFDDISPVTTSGKVNVKARFTASYGGMPRLDYKVYDPNAKEDDRTIIYPVALDLFINNLPNRTDLRGATFPVGKINYHFNFSGKVDWDNKSLGAETLNFEGRDKPMKIFNYQAIDKIVDKVPQEGTESFEIGMKGYKDTRTEVANSPKSYIPRDKWNASDIDKYTIDSVWDSGTVRLNKPEITKDHVGYTGSIEDYVIGSTFPTMMSRPGSPTIPTFGKNEKAFSSTRFLIHSTNEYYPFGKNNKENLPNNVYYYLEFVIDSYEDSKGNTIPYNTVGKYTLTERNNPKGSYSIQTTFHTTDHKELGTPHVGYSVVSKGDPTVIVGQKVKLISHLNVRAVTEGGTTMVYKWNTDSFYLTKGSAEIARKDMLNQGYPNTSGGRIKDSDKQKIYFGISKKEDNSFETLTQNKDEDYNWYSTYDEARKNGEVGAIKNDINASMGDGEVVAWNIPLEVKTKKIGSVNEKGTPNITVTDSVVYPSADRKVGYRVRGEGKYNNFTEYDEKGNITKLQSPVGSTVNFETLGIMNGETSSDVKTNKNTYYSSDNVSVTVDNLVKLPDAMDYNSLDEKVEMRVKIPKGLDYVVGSAKYGDQYIEPKIEQQNDGSNHLIWHDTLTRGNKTLKKINFETRINPVLLPQGNQVGLEIKNVLSSAMDTRAEKFRTSSKNISVVKIGMVGVSETIEKVTGKKNSDYVVGVQPYTTIKDESHIKALTYVPRNKDHNGSAFNGVTFLKQIALENANNKNVEIWLNNSFVESNNPNKIDLNSNGWYRYTGEQDLSKVVSILLYINDSLSSSDIVKMNLVYGTNKNEFGDFYVSKTVVNTSVDYKLSPVSNQVKYTIVADANLGLRKIRIDTAPTDIGLPVIVRLDKDIIYEDSNKSNVAVNLYDKADNKLVDSKVYTIEELPEEIKFKVDPKFLKKHDKRNYEVRFEKVNKESILILDGKGKVDTDGYTSSEETVKANAKASTELKYKGVIMTEREVGKEMEIFYETLTIPLKQLPKQKTGYGFELKPLVSYNNELAVPYDVKANAFVDKRLIDSHLNYEKKGDQMVVPLEEAEKTGSTDKKNTDFLFELPHINVEQKTGNLFTDQQVKDHDPRIKNAIKDGKRKLYVPIWADLGEYNVLIASGIPIGANKVNFEVTQPLNLYAYMYGTIGSKTLKDDELLLEPVDPKNPFSNGKPPGWSDEDVAWLKQ

SEQ ID NO: 358 - protein, 1426 aa, Bacillus Sp.
MVVKRGGIRLWFRRSFSLLFVVMLLFGSLADFVSIGHAESTSDQKQAQENKTNDVTVLQEKSDLKSTGTNPNEVVVAKGKKGSELFDFEAFIKPSDIVDGTAPFDSNDEAGNDSSPNNGIVRTFDTVTYPLKVTINPKKNETLKNIKMKITGTLENGITNKRVNAKFAVGGKEDLEKGIVSFDMEYTLKETGNSLMIPVTLEIQGAEQGLKLKPNIKIQVISVDGKDIQDENVSQSFDDISPVTTSGKVNVKARFTASYGGMPRLDYKVYDPNAKEDDRTIIYPVALDLFINNLPNRTDLRGATFPVGKINYHFNFSGKVDWDNKSLGAETLNFEGRDKPMKIFNYQAIDKIVDKVPQEGTESFEIGMKGYKDTRTEVANSPKSYIPRDKWNASDIDKYTIDSVWDSGTVRLNKPEITKDHVGYTGSIEDYVIGSTFPTMMSRPGSPTIPTFGKNEKAFSSTRFLIHSTNEYYPFGKNNKENLPNNVYYYLEFVIDSYEDSKGNTIPYNTVGKYTLTERNNPKGSYSIQTTFHTTDHKELGTPHVGYSVVSKGDPTVIVGQKVKLISHLNVRAVTEGGTTMVYKWNTDSFYLTKGSAEIARKDMLNQGYPNTSGGRIKDSDKQKIYFGISKKEDNSFETLTQNKDEDYNWYSTYDEARKNGEVGAIKNDINASMGDGEVVAWNIPLEVKTKKIGSVNEKGTPNITVTDSVVYPSADRKVGYRVRGEGKYNNFTEYDEKGNITKLQSPVGSTVNFETLGIMNGETSSDVKTNKNTYYSSDNVSVTVDNLVKLPDAMDYNSLDEKVEMRVKIPKGLDYVVGSAKYGDQYIEPKIEQQNDGSNHLIWHDTLTRGNKTLKKINFETRINPVLLPQGNQVGLEIKNVLSSAMDTRAEKFRTSSKNISVVKIGMVGVSETIEKVTGKKNSDYVVGVQPYTTIKDESHIKALTYVPRNKDHNGSAFNGVTFLKQIALENANNKNVEIWLNNSFVESNNPNKIDLNSNGWYRYTGEQDLSKVVSILLYINDSLSSSDIVKMNLVYGTNKNEFGDFYVSKTVVNTSVDYKLSPVSNQVKYTIVADANLGLRKIRIDTAPTDIGLPVIVRLDKDIIYEDSNKSNVAVNLYDKADNKLVDSKVYTIEELPEEIKFKVDPKFLKKHDKRNYEVRFEKVNKESILILDGKGKVDTDGYTSSEETVKANAKASTELKYKGVIMTEREVGKEMEIFYETLTIPLKQLPKQKTGYGFELKPLVSYNNELAVPYDVKANAFVDKRLIDSHLNYEKKGDQMVVPLEEAEKTGSTDKKNTDFLFELPHINVEQKTGNLFTDQQVKDHDPRIKNAIKDGKRKLYVPIWADLGEYNVLIASGIPIGANKVNFEVTQPLNLYAYMYGTIGSKTLKDDELLLEPVDPKNPFSNGKPPGWSDEDVAWLKQ

SEQ ID NO: 359 - protein, 1417 aa, Bacillus Sp.
MWFRRSFSLLFVFMLLFGSLADFVSIGHAESTSDQKQAHENKTDDVTVLQEKSDLKSTGLNPNEVVVANGKKGSELFDFEAFIKPSDIVDGTAPFDSNDEAGNDSSPNNGIVRTFDTVTYPLKVTINPKKNETLKNIKMKITGTLENGITNKRVNAKFAVGGKEDLEKGIVSFDMEYTLKETGNSLMIPVTLEIQGAENGLKLKPNIKIQVISVDGKDIQDENVSQSFDDISPVTTSGKVNVKARFTASYGGLPRLDYKVYDSNAKKDDRSIMYPVALDLFVDNLPNRNDLRGATFPVGKINYHFNFSGKVDWDEKSLGQEALDFEGRDTPIKIFNYQAIDKIVDKVPQENTESFELGIKGYKDPRTETANSPKSYIPKEKWNAGDIDKYTIDSVWDSGTVRLNKPEITKNRIGYAGSIDDYVIGRTFPTMMSRPNYPVIPTFGKNQKAFSSTRFLIHSPNEYYPFGKNNKQNLHNNVYYYLEFVIDSYEDGKGNTIPYNTVGRYTLTERNNPKGSYSIQTTFHTPEGKELGTPNVGYGAVSKGDPTVIVGQKVKIISHLNVRAVTEGGTTMVYKWNTDSFNLTKNGADIAKKDMLHQGYPNTTGGRDKDVNKQKIYFGVSKKNDNSFETITQNKDEDYEWFSTYDEAKTHGEVGAMKNDIHALMGDGEVVAYNIPLDVKTKKVGSVNEKGTPNITVTDSVVYPTSDRKIGYRVRSEGKYNNFTEYDEKGNVIKLQSPVGSTVNFETLGIMNGETSSEVKTNKNTYYSSDNVSVTVDNLVRLPEAMDYTSLDEKIEMRVKIPKGLDYVVGSAKYGDQYIEPKIEQQSDGSNHLIWHDTLTRGNKALKKINFETRINPVLLPQGNQVGLEIQNVMSSSMDTRLEKFRTSSKNISVVKIGMVGVSETIEKVTGKKNSDYVVGVQPYTTIKDESHIKALTYVPRNKDHNGSAFNGVTFLKQISLENANNKNVEIWLNNSFVESNNPNKIDLNSNGWYRYTGEQDLSKVVSILLYINDSLSSSDVVKMNLGYGTYKNEFGDFYVSKTVVNTSVDYKLSPVSNQVKYTIVADANLGLRKIRIDTAPADIGLPVIVRLDKDIIYEDSNKSNVAVNLYDKADNKLVDSKVYTIEELPEEIKFKVNPKFLKKNNKRNYEVRFEKVNKESILILDGKGKVDTDGYTSSEETVKANAKASTELKYKGVIMTEREVGKEMEIFYETLTIPLKQLPKQKTGYGFELKPLVSYNNELAVPYDVKANAFVDKRLIDSHLNYEKKGDQMVVPLEEAEKIGSTDKKNTDFLFELPHINVEQKTGNLFTDQQVKDHDPRIKNAIKDGKRKLYVPIWADLGEYNVLIVSGIPIGANKVNFEVTQPLNIYAYMYGTIGSETLKDDEILLEPVDPKNPFSSGKPPGWSDEDVAWLKR

SEQ ID NO: 360 - protein, 1426 aa, Bacillus Sp.
MVVKRGGIRLWFRRSFSLLFVFMLLFGSLADFVSIGHAESTSDQKQAHENKTDDVTVLQEKSDLKSTGLNPNEVVVANGKKGSELFDFEAFIKPSDIVDGTAPFDSNDEAGNDSSPNNGIVRTFDTVTYPLKVTINPKKNETLKNIKMKITGTLENGITNKRVNAKFAVGGKEDLEKGIVSFDMEYTLKETGNSLMIPVTLEIQGAENGLKLKPNIKIQVISVDGKDIQDENVSQSFDDISPVTTSGKVNVKARFTASYGGLPRLDYKVYDSNAKKDDRSIMYPVALDLFVDNLPNRNDLRGATFPVGKINYHFNFSGKVDWDEKSLGQEALDFEGRDTPIKIFNYQAIDKIVDKVPQENTESFELGIKGYKDPRTETANSPKSYIPKEKWNAGDIDKYTIDSVWDSGTVRLNKPEITKNRIGYAGSIDDYVIGRTFPTMMSRPNYPVIPTFGKNQKAFSSTRFLIHSPNEYYPFGKNNKQNLHNNVYYYLEFVIDSYEDGKGNTIPYNTVGRYTLTERNNPKGSYSIQTTFHTPEGKELGTPNVGYGAVSKGDPTVIVGQKVKIISHLNVRAVTEGGTTMVYKWNTDSFNLTKNGADIAKKDMLHQGYPNTTGGRDKDVNKQKIYFGVSKKNDNSFETITQNKDEDYEWFSTYDEAKTHGEVGAMKNDIHALMGDGEVVAYNIPLDVKTKKVGSVNEKGTPNITVTDSVVYPTSDRKIGYRVRSEGKYNNFTEYDEKGNVIKLQSPVGSTVNFETLGIMNGETSSEVKTNKNTYYSSDNVSVTVDNLVRLPEAMDYTSLDEKIEMRVKIPKGLDYVVGSAKYGDQYIEPKIEQQSDGSNHLIWHDTLTRGNKALKKINFETRINPVLLPQGNQVGLEIQNVMSSSMDTRLEKFRTSSKNISVVKIGMVGVSETIEKVTGKKNSDYVVGVQPYTTIKDESHIKALTYVPRNKDHNGSAFNGVTFLKQISLENANNKNVEIWLNNSFVESNNPNKIDLNSNGWYRYTGEQDLSKVVSILLYINDSLSSSDVVKMNLGYGTYKNEFGDFYVSKTVVNTSVDYKLSPVSNQVKYTIVADANLGLRKIRIDTAPADIGLPVIVRLDKDIIYEDSNKSNVAVNLYDKADNKLVDSKVYTIEELPEEIKFKVNPKFLKKNNKRNYEVRFEKVNKESILILDGKGKVDTDGYTSSEETVKANAKASTELKYKGVIMTEREVGKEMEIFYETLTIPLKQLPKQKTGYGFELKPLVSYNNELAVPYDVKANAFVDKRLIDSHLNYEKKGDQMVVPLEEAEKIGSTDKKNTDFLFELPHINVEQKTGNLFTDQQVKDHDPRIKNAIKDGKRKLYVPIWADLGEYNVLIVSGIPIGANKVNFEVTQPLNIYAYMYGTIGSETLKDDEILLEPVDPKNPFSSGKPPGWSDEDVAWLKR

SEQ ID NO: 361 - protein, 1417 aa, Bacillus Sp.
MWFRRSFSLLFVVMLLFGSLADFVSIGHAESTSDQKQAQEKKTDDVTVLQEKSDMKSMGLAPGEVVVANGKKGSDLFDFEAFIKPSDIVDGTAPFDSNDEAGNDASPNNGVVRTFDTVTYPLKVTINPKKHDKLKDIKLRITGTLENGITNKRVNAKFAVGGKEDLESGVVSFDMEYTLKETGNSLMIPVTVEVQGAEHGLKLKPNINIQVVSVDGKDITNEGISQSFNDISPVTTSGKVNVKARFTASYGGLPRLDYKVYDSNAKKDDRSIMYPVALDLFVDNLPNRNDLRGATFPIGKINYHFNFSGKVDWDEKSLGQETLDFEGRDMPIKIFNYQAIDKIVDKVPQENTESFELGMKGYKDPRTETANSPKSYIPKDKWNASDIDKYTIDSVWDSGIVRLNKPEITKNRIGYAGSIDDYVIGRTFPTMMSRPNYPVIPTFGKNQKAFSSTRFLIHSPNEYYSFGKNNKQNLPNNVYYYLEFVIDSYEDGKGNTIPYNTVGRYTLTERNNPKGSYSLQTTFHTPEGKELGTPNVGYSAVSKGDPTVIVGQKVKIISHLNVRAVTEGGTTMVYKWNTDSFDLTKNGADIAKKDMLYQGYPNTTGGRDKDVNKQKIYFGVSKKNDNSFETITQNKDEDYDWYSTYDEAKTHGEVGAIKNDIHALMGDGEVVAYNIPLDVKTKTVGSINEKGTPNIAVTDSVVYPTADRKVGYRVRGEGKYNNFTEYDEKGNVTKLQSPVGSTVNFETLGIMNGETSSEVKTTQNTYYSSDNVNVTVDNLVRLPEAMDFTSLDEKVEMRVKIPKGLDYVVGSAKYGDQYVEPKIEQQNDGSNHLIWYDTLTRGNKALKKINFETRINPVLLPQGNQVGLEIQNVMSSSMDTRLEKFRTSSKNISVVKIGMVGVSETIEKVTGKKNSDYVVGVQPYTTIKDESHIKALTYVPRNKDENGSAFNGVTFLKQLTLENANNKNVEIWLNNSFVESNNPNKIDLKSNGWYRYTGEMDLSKVVSILLYVNDSLSSSDVVKMNLVYGTHKNEFGDFYVSKTVVNTSVDYKLSPVSNQVKYTIVADANLGLRKIRIDTAPAEIGLPVTVRLDKDIVYEDSNNEKLTVNLYDKADNKLVGSKVYTIGELPEEIKFKVDPKFLKKNNKRNYEVRFEKVNKESVHVLDGKGKVDTDGYTSSEESIKVNAKESTELRYKGAIMTEREVGKEMEIFYETLTIPLKQLPKQKTGYGFELKPLVSYNNELAVPYDVKANALVDKRLIDSHLNYEKKGDQMVVPLEEAEKTGSTDKKNTDFLFELPHINVEQKTGNLFTNQQVKDHDPRIKNAIKDGKRKLYVPIWAELGEYNVLIASGIPIGANKVNFEVTQPLNLYAYMYGTIGSETLKDDELLLEPVDPKNPFSNGKPPGWSDEDVAWLKQ

SEQ ID NO: 362 - protein, 1415 aa, Bacillus Sp.
MWFRRSFSLLFVVMLLFASLADFVSIGHAESTSDQKQAQEKKTDDVTVLQEKSDLKSTGINPNEVVVANGKKGSELFDFEAFIKPSDIVDGTAPFDSNDEAGNDSSPNNGIVRTFDTVTYPLKVTINPKKNETLKNIKMKITGTLENGITNKRVNAKFAVGGKEDLEKGIVSFDMEYTLKETGNSLMIPVTVEVQGAEHGLKLKPNIKIQVISVDGKDIANENVSQAFDDINPVTASGKVNVKAKFSTHYAGMPRLSYSVFNPKVDKDDRSFIFPVVLSLFVDNLPNRSDIRGATFPAGKVNYHFDFSGRVDWDSKSMGVDKLDFERKDTPFTIFNYQDIDNISKKIPQPNTESFEIGLDSYEDVRTVQSGSAKSYIPKEKWNASDIEKYTIDSVWDSGITQISKPKVSKDVINYEGNISDFTIGSTFPTMISHDNRVVAFNKNQKAFATTRFLIHTPNEYYPLAKNNKINKANNVYYDLKCIIDSYEDSKGNVVPYNTTAAVTITERNNPKGSYSIQTTFHTPEGKELGTPNIGYSAVSKGDPTIIVGQRVKVVSHLNVRAVTEGGTTMVYKWNTDSFYLTKQYAEAAKTNMLNEGYPTSSGGRVKNSDKQVISFGIAKKNDNSFEALTQNKAEDYEWYSTYDEARKHGEVGAIKNDINAVMGDGEVVASYIPFDVKTKKIGSLNEKGTPNITVTDSVVYPTADRKIGYRIREDGKYNNFTEYDENGNLTKLQSPVGSTINFETLGIINGETSSDIKTNKNTYYSSDNVNITVDNLAKLPAETDFNSLDEKVEMRVKIPKGLDYVVGSAKYGDQYVEPKIEQQSDGSNHLVWYDTLTRGNKALKKINFETRINPVLLAQGNQVGLEIQNVMSSSMDTRLEKFRTSSKNISVVKIGMVGVSETIEKVTGKKNSDYVVGVQPYTTIKDESHIKALTYVPRNKDHNGSAFNGVTFLRQIALENANNKNVEIWLNNSFVESNNPNKIDLKSNGWYKYTGEQDLSKVVSILLYINDSLSSSDIVKMNLVYGTHKNEFGDFYVSKTLVNTSVDYKLSPVSNQVKYTIVADANLGLRKIRIDTAPADIGLPVIVRLDKDIIYEDSNKSNVAVNLYDKSDNKLVDSKVYTIQELPEEIKFKVDPKFLKKNNKRNYEVRFEKVNKESIFIVDGKGKVDTDGYTSSEETVKANTKASTELKYKGVIMTEREVGKEMEVFYETLTIPLKQLPKQKTGYGFELKPLVSYNNELAVSYDVKANTLVDKRLIDSHLNYEKKGDQFVVPLEEAEKTGSTDKKNTDYLFELPHINVEQKTGNLFTDQQVKDHDPRIKNAIKDGKRKLYVPIWADLGEYNVLIASGIPIGANKVNFEVTQPLNLYAYMYGTIGSKTLKDDELLLEPVDPKNPFSNGKPPGWSDEDVAWLKQ

SEQ ID NO: 363 - protein, 1415 aa, Bacillus Sp.
MWFRRSFSLLFVAMLLFGSLADFVSIGHAESTSDQKQAQEKKTDGVTVLQEKSDMKSMGLAPGEVVVANGKKGSELFDFEAFIKPSDIVDGTAPFDSNDEAGNDSSPNNGIVRTFDTVTYPLKVTINPKKNETLKNIKMKITGTLENGITNKRVNAKFAVGGKEDLEKGIVSLDMEYTLKETGNSLMIPVTVEVQGAEHGLKLKPNIKIQVMSVDGKDIMNEKVSQSFDDISPVTASGKVNVKAKFSTNYAGMPRLSYSVFNPKVDKDDRSFIFPVVLSLFVDNLPNRSDIRGATFPVGKVNYHFDFSGRVDWDSKSMGVDKLDFEGKDTPFKIFNYQAIDNISKKIPQPNTESFEIGLESYEDVRTIQSGSAKSYIPKEKWNANDIDNYTINSVWDSGITQISKPKVSKDVINYEGNVSDFTIGSTFPTMISHDSRVVAFSKNQKAFATSRFLIHTPNEYYPLAKNNKINKANNVYYDLKCIIDSYEDSKGNVVPYNTTAAVTITERNNPKGSYSIQTTFHTPEGKELGTPNIGYSAVSKGDPTIIVGQKVKVVSHLNVRAITEGGTTMVYKWNTDSFYLTKQYAESAKANMLNEGYPTSSGGRVKNSDKQVISFGVAKKNDNSFEALTQNKAEDYEWYSTYDEARKYGEVGAIKNDINAVMGDGEVVASFIPFDVKTKKIGSLNEKGTPNITVTDSVVYPTADRKVGYRVREDGKYNNFTEYDENGNLTKLQSPVGSTINFETLGIINGETSSDIKTNKNTYYSSDNVSVTVDNLVKLPAETDFNSLDEKVEMRVKIPKGLDYVVGSAKYGDQYVEPKIEQQSDGSNHLIWHDTLTRGNKALKKINFETRINPVLLPQGNQVGLEIQNVMSSSMDTRLEKFRTSSKNISVVKIGMVGVSETIEKVTGKKNSEYVVGVQPYTTIKDESHIKALTYVPRNKDQNGSAFNGVTFLKQIALDNDNNKNVEIWLNNSFVESNNPNKIDLKSNGWYRYTGEQDLSKVVSIFLYINDSLSSSDIVNMKLVYGTYKNEFGDFYVSKTVVNTSVDYKLSPVSNQVKYTIVADANLGLRKIRIDTAPADIGLPVSIRLDKDIVYEDSNKSNITVNLYDKADNKLVASKVYTIEELPEEIKFKVDPKFLKKNNKRNYEVRFEKVNKESILIVEGKGKVDTDGYTSSEETLKANAKASTELLYKGVIMTEREVGKEMEIFYETLTIPLKQLPKQKTGYGFELKPLVSYNNELAVPYDVKANALVDKRLIDSHLNYEKKGDQMVVPLEEAEKTGSTDKKNTDFLFELPHINVEQKTGNLFTDQQVKDHDPRIKNAIKDGKRKLYVPIWADLGEYNVLITSGITIGANKVNFEVTQPLNLYAYMYGTIGSKTLEDDELLLEPVDPKNPFSNGKPPGWSDEDVAWLKQ

SEQ ID NO: 364 - protein, 1418 aa, Bacillus Sp.
MWIRRTCSLLLVFIVLLGNLVDSVSIGYAESASNQEQGQEKKVEDVTVLQEKSDMNTMGLSPNELVIADGKKGSDLFDFEAFIKPSDIVDGTAPFDSNDEAGNDSSPNNGIVRTFDTVTYPLKVTINPKRHDQLKNIKLKITGTLENGITNKRVNAKFAVGGKEDLEKGIVSFDMEYMLKETGNSLMIPVTVEVQGAEHELKLKPNIKIQVMSVDEKDITNENISQSFDDISPVTTSGKVNVKARFTASYGGLPRLDYKVYDSNAKKDDRSIMYPVALDLFINNLPNHKDLRGATFPSGKINYHFNFSGKVDWDEKALGQEPLDFEGRDTPIKIFNYQAIDKIVDKVSQENTESFEIGMKGYKDSRTEVANSPKSYIPKDKWNASDIDKYTIDSVWDSGVVYLNKPEITKNRIAYAGSIKDYIIGTTFPTMMSRPNYPVIPTFGKDERAFSSTRFLIHSSNEYYPFGKNNKSNLPNNVYYYLEFVIDSYEDGKGNTVPYNTVGRYTLTERNNPKGAYSLQTTFHTPEGKELGTPNVGYGAVSKGDPTVIVGQKVKIISHLNVRAVTEGGTTMVYKWNTDSFYLTKNGAEIAKKDLLNQGYPNTTGGRDKDVNKQQIYFGVSKNNDNSFESLTQNRDEDYDWYSKYDEAKTHGEIGAIKNDINALMGDGEVVAYNIPLDVKTKKIGSVNEKGTPNITVTDSVVYPAADRKVGYRVRSEGKYNNFTEYDEKGNITKLQSPVGSTVNFETLGIMNGETSSEVKTNKNTYYSSDNVSITIDNLAKLPEAMDFTSLDEKVEMRVKIPKGLDYVVGSAKYGEKYVEPKIEQQSDGSNHLIWYDTLTRNNKVLKIINFETRINPVLLPQGNQVGLEIQNVMSSTMDTRLEKFRTSSKNVSVVKIGMIGVSETIKKVAGKKNSDYEIGVQPYTTIKDEAHVKALTYVPRNKDENGSAFNGVTFLKQLTLENANNKNVEMWLNNNFIESNNPNKIDLQSNGWYRYTGEQDLSKVVSILLYVKDSLSSSDVVKMNLVLGTYKNDFGNQYVSKTIVNTSVDYKLSPVSNQVKYTIVADVNLGLRKIRIDTAPADTGLPVSIRLDKDIVYEDSNKSKVAVNLYDKVDNKLVGSKVYTIEELPEEIEFKVNPGFLKKNNKRNYEVRFEKVNKESILIMDGKEKVDTDGYTSSEETVKVNAKESNELKYSGVIMTEREIGKEMEVFYETLKMPLKQLPKQKTGYGFELKTEASYNNELAAVFDIKANALVDKRLIDSYLNYEKKGTKIVIPLEETKKTGSTDKKNMDFLFELSHINVEQKTGNLFTDQQVKEHDSRIKNAIKDGKRRLYVPIWADLGTYDVFVVSGIPIGVNKINFEVMQPLQLYAYMYGTIGSRTLKDDELLIEPVDPKNPFSNGKPSDWSDEDIAWLRKD

SEQ ID NO: 365 - protein, 1424 aa, Bacillus Sp.
MVVKRGGIRLWLRRSFSLLFVVMLLFGSLADFVSIGHAESTSDQKQAQEKKMDDVTVLQEKSDMKSMGLDPNEVVVADGKKGSELFDFEAFIKPSDIVDGTVPFDKNDEAGNDSSPNNGIVRTFDTVTYPLKVTINPKKNETLKNIKLKITGTLENGITNKRVNAKFAVGGKEDLESGVVSFDMEYTLKETGNSLMIPVTVEVQGAEHGLKLKPNIKIQVMSVDGKDITNEKVSQSFDDISPVTASGKVNVKAKFSTNYAGMPRLSYSVFNPKVDKDDRSFIFPVVLSLFVDNLPNRSDIRGATFPVGKVNYHFDFSGRVDWDSKSMGVDKLDFEGKDTPFKIFNYQAIDNISKKIPQPNTESFEIGLDSYEDVRTIQSGSAKSYIPKEKWNASDIDNYTINSVWDSGITQISKPKVSKDVINYEGNISDFTIGSTFPTMISHDSRVVAFNKNQKAFATTRFLIHTPNEYYPLAKNNKINKANNVYYDMKCIIDSYEDSKGNVVPYNSTAAVTITERNNPKGSYSIQTTFHTPEGKELGTPNIGYNVVSKGDPTIIVGQKVKVVSHLNVRAVTEGGTTMVYKWNTDSFYLAKQYAESAKANMLNEGYPTSSGGRVKNSDKQVISFGIAKKNDNSFEALTQNKAEDYEWYSTYDEARKYGEVGAIKNDINAVMGDGEVVAGFIPFDVKTKKIGSLNEKGTPNITVTDSVVYPTADRKVGYRVREDGKYNNFTEYDENGNLTKLQSPVGGTINFETLGIINGETSSDIKTNKNTYYSSDNVSVTVDNLAKLPAETDFNSLDEKVEMRVKIPKGLDYVVGSAKYGDQYVEPKIEQQNDGSNHLIWHDTLTRGNKALKKINFETRINPVLLPQGNQVGLEIQNVMSSSMDTRLEKFRTSSKNISVVKIGMVGVSETIENVTGKKNSDYVVGVQPYTTIKDESHIKALTYVPKNKDENGSAFNGVTFLKQLTLENANNKNVEIWLNNSFVESNNPNKIDLKSNGWYRYTGEMDLSKVVSILLYVNDSLSSSDVVKMNLVYGTHKNEFGDFYVSKTVVNTSVDYKLSPVSNQVKYTIVADANLGLRKIRIDTAPAEIGLPVTVRLDKDIVYEDSNKSEVAVNLYDKADKKLVGSQVFTIGELPEEIKFKVDPKFLKKNNKRNYEVRFEKVNKESIHVLDGKGKVDTDGYTSSEESIKVNAKESTELKYKGVIMTEREVGKEMEIFNETLTIPLKQLPKQKTGYGFELKPLVSYSNELAVAYDIKANALVDKRLIDSHLNYEKKGDQIVVPLEEAEKTGSSDKKNTDFLFELPHINVEQKTGNIFTDQQVKDHDPRIKNAIKDGKRKLYVPIWADLGEYNVLTASGIPIGANKVNFEVTQPLNLYAFMYGTIGSKTLKDDELLLEPVDPKNPFSNGKPPGWSDEDVAWLKQ

SEQ ID NO: 366 - protein, 1391 aa, Bacillus Sp.
MNKEAVQAKKTDDVTVLQEKSDLESMGVTPNEVVVADGKKGSELFDFEAFIKPSDIVDGTAPFDSNDEAGNDSSPNNGIVRTFDTVTYPLKVTINPKNHNQLKNIKLRITGTLENGITNKRVNAKFAVGGKEDLEEGVVSFDMEYMLKETGNSLMIPVTVEVQGAEHNLKLKPNIKIQVMSVEEKDITSENVSQSFKNISAVTTSGKVNVKARFTTSYAGLPRLDYKVYNPDAKNDDRTIIYPTALDLFINNLPNRTDLRGATFPVGKINYHFNFSGKVDWDNNSLGSETLDFEGRDKLIKIFNYQAIDKIVDKIPQEGTESFEIGMKGYKDPRTESANSPKSYIPKDKWNTSDIDKYTIDSVWDSGVVRLNKPQITKERVEYTGSIEDYVIGSTFPTMMSRPNYPIIPTFGKNEKAFSSTRFLIHSANEYYSFGKNNKDNLPNNVYYYLEFVIDSYEDGKGNTVPYNTVAKTTLSERNNPKGAYSIQTTFHSPEGKELGTPNVGYTIVSKGDPTVIVGQNVKIVSDLNVHAVTEGGAMMVYKWNPDSFYLSKDYAEQAKNQMLSEGYPISTGGRIRNSDKQIISFGVSKTNDNSFEAITQKQAEDFDWFSTYDEARKYGEVGAIKNDVHAEIADGVLAARNIPLTVKVKKIGSINEKGTPNIAVTDAVIYPTADRKKGYRVRENGKYNNFTEYDEKGNITKIQSPVGSTVNFETLGIMNGETSSDVKTNKNTYYSSDNVSVTIDNLAKLPDSMDSTSLDEKVEMRVKIPKGLDYVVGSARYGDQYIEPKIEQQGDGSNHLVWYDTLTRNNKTLKKINFEARINPVLLPQGNQVGLEIQNVMSSSMDTRLEKFRTSSKNISIVKIGMVGVSETIKKVAGKKNSDYEIGIQPYTTIKDESHVKALTYVPRNKDGNGSAFHGVTFLKQLTLENGNSKNVEIWLNNSFVESNDPNKVNLQLNGWYRYTGEQDLSKVVSILLYINDSLSSSDVVKMNLVLGTYNNEFDDQYVSKTVVNTSVDYKLSPVSNQVRYTIVADANVGLRKIRIDTAPAENGLPVTVRLDKDIVYEDSNKEKLNINLYDKADNKLVESKVYTIEELPEEIKFKVDSKFLKKNNKRNYEVRFEKVNKESILIMNGKEKVDTDGYTSSEETIKANAKESTELKYKGVIMTEREVGKEMEVFYETLTIPLKRLPKQKTGYGYELKTEISYHNELAIPNDIKAGALVDKKLIDSHLNYEKKEDNIIVPLEETKKNVTSDKKNTDVTFELPHINVEQKTGNLFTDQQVKDKDSRIKNVLKDGKRKLYAPIWADLGEYNLLIHSNLPIGANKVNFEVTQPLQLYAYMYGTMGSKTLKNDELLIEPVDPKNPFSNGKPAGWSDEDVAWLKRDEKSNQ

SEQ ID NO: 367 - protein, 163 aa, unknown
  environmental sample
MAIDVYLQIDGIKGESTDTSHKDWIECRSVQWEVLQPKSATASTGGGHTAERTEHKDIVIAKLADLATPLLLQNCSSGKTIPKAKIEFLRADGQGERIKYFEIELENVLISNVSPRVEAGDILSENLSLKYSKVKWKYTQQKVGGGSGGNTSGGWDLSANKTA

SEQ ID NO: 368 - protein, 163 aa, Janthinobacterium Sp.
MAIDVYLQIDGIKGESTDTSHKDWIECKSVQWEVLQPKSATASTGGGHTAERTEHKDIVVAKLADLATPLLLQNCSSGKTIPKAKFEFLRADGQGERIKYFEIELENVLISSVAPSVAAGDILGENVSIKYSKVKWKYTQQKVGGGSGGNTSGGWDLSANKTI

SEQ ID NO: 369 - protein, 163 aa, Janthinobacterium Sp.
MAIDVYLQIDGIKGESTDTGHKDWIECKSVQWEVLQPKSATASTGGGHTAERTEHKDIVIAKLADLATPLLLQNCSSGKTIPKAKIEFLRADGQGERIKYFEIEIENVLISSVSPRVVAGDILTEDLALKYSKVKWKYTQQKVGGGSGGNTSGGWDLSANKTA

SEQ ID NO: 370 - protein, 163 aa, Janthinobacterium Sp.
MAIDVYLQIDGIKGESTDATHKDWIECKSVQWEVLQPKSATASTGGGHTAERTEHKDIVIAKLADLATPLLLQNCSSGKTLPKAKIEFLRADGQGERIKYFEIELENVLISSVAPAVHAGDILSENLSLKYSQVKWKYTQQKVGGGSGGNTSGGWNLSTNKTV

SEQ ID NO: 371 - protein, 163 aa, unknown
  Oxalobacteraceae
MAIDVYLQIDGIKGESADATHKDWIEVSTVQWEVLQPKSATASTGGGHTAERTEHKDIVVSKLADLATPLLLQTCSSGKTIPKAKLEFLRADGNGERIKYFEIELENVLISSVAPTVKQGNILTEDVAIKYSKVKWKYTQQKVGGGSGGNTSGGWDLSANKTA

SEQ ID NO: 372 - protein, 163 aa, Collimonas Sp.
MAIDVYLQIDGIKGESTDSAHKDWIECKSVQWEVLQPKSATASTGGGHTAERCEHKDIVVTKIADLATPLLLQNCSSGKTIPKAKFEFLRADGKGDRIKYFEIELVNLLISDVTPSVQEGDVLSESISLKYSQVKWKYTQQKIGGGSGGNTSGGWDLSTNKVV

SEQ ID NO: 373 - protein, 163 aa, Collimonas Sp.
MAIDVYLQINGIKGESTDSAHKDWIECKSVQWEVLQPKSATASTGGGHTAERCEHKDIVITKIADLATPLLLQNCSSGKTIDSAKFEFLRADGKGDRIKYFEIELSNLLISDVTPSVQEGDVLSESVSLKYSKVKWKYTQQKIGGGSGGNTSGGWDLSTNKVV

SEQ ID NO: 374 - protein, 163 aa, Collimonas Sp.
MAIDVYLQISGIKGESTDGAHKDWIECKSVQWEVLQPKSATASTGGGHTAERCEHKDIVITKIADLASPLLLQNCSSGKTIDSAKFEFLRADGKGDRIKYFEIELSNVLISDVTPSVAEGDVLNESVSLKYSKVKWKYTQQKIGGGSGGNTSGGWDLSTNKVV

SEQ ID NO: 375 - protein, 163 aa, unknown
  environmental sample
MAIDVYLQIDGIKGESTDQTHKDWIEVKSVDFGVLQPKSATASTGGGHTAERTEHKDVLISKLADLATPILLQTCSQGKTIPKAKLEFLRADGQGDRVKYFEIELENVLISSVAPTIRPGDILSEDVSLKYSKVKWKYTQQKVTGGTGGNTSGGWDLSTNRIA

SEQ ID NO: 376 - protein, 163 aa, Janthinobacterium Sp.
MAIDVYLQIDGIKGESTDDKHKDWIECKSVSWSVEQPKSATASTGGGHTAERCEHKDIVISKLADLASPILLQTCSAGKTIPKAHFEFMRADGQGERIKYFEIEIENVLIGAVTPNVHEGDILTEQVGFKFSKVKWKYTQQKVTGGAGGNTSGGWDLAANKVV

SEQ ID NO: 377 - protein, 956 aa, Stenotrophomonas Sp.
MKHSKLSLALAGLIAVGAIAAADDVMAMSYHVQGDRIFLSGGVTYADVVSLPALLAKAQAEGRPIREVVLRTSNGGALIAGEWLQGVIRTSGLNTIVSGHCISSCSIMQSGGVERYLAGDLPIVDSVQIHAASNSGKVIYTPSPRMTQIYTGNYGGGIDAGLLHKAMYEVVQPNGLLVFRDPARTTGASVTFDPDGSGSKLESFPGQDIYSNRVITAKGYRDPGDTLNVTANVSGDINPGYLRTGRQLQTFVDDDFARWNTNWQSSYINLAQSIYNASSNGPQGIGANSVQDYQNDPTYKALLLSKLRLGDLDASTLDNSMGVIRVTSGATWRTSATTGADFMLVDNGTIALEGGALRASEVRVMGAGMLVGNGDVAGTAMDLSALASGTRPSWREDGFNRLRVYGTLMPRGGDLVTHGYVNIMPGGKVLFDVTENGGAGSGRLRVGSFFDSKQTDGALVISKGAFLELNVAQGYYGQDFRRDLVQGPIYQGGFEEVVRLGDTGYSASITGGEVFRPRHNSLLSFNVKQAADGLWLTANPGFDQLGLFTNGTSGDGLGRALATASDRRDGGLKSLLGALQFADRDVIAQQAGTLRGDAHATLRLADNALVGSIGDVVQQHQAAMRSGGDADGLASQAAQSVSAQPGMRHGSLFNQLAMHLVEPAAGGGEGSGSGRNHGLWARGFASHGRIDADGGVAGLSHNIGGIVVGADTRVADDRVTLGVSVAAADMSTKGRDGSDFSGDVRALDVGGYLDATYSRGYLSAAVRYTDLRHDTRRSVSGIDGLQQPLRAKYSNDAISARVEHAFSFTTGKGLVIQPLLPVVDYARTSATRFNEGQGAGALVGRSGSLESIRVGAGLQLFRTFEGNNGERITPRARVVWQKELGDSQARYSTGFAAAPDLVFGASSQAVGEQVLAWNLGVTSRASERLSIMADYVGERRDGQIQNGVMLGLGYKF

SEQ ID NO: 378 - protein, 956 aa, Stenotrophomonas Sp.
MKHSKLSLALAGLIGVGAIAAADDVMAMSYHVQGDRIFLSGGVTYADVVSLPALLAKAQAEGRPIREVVLRTSNGGALIAGEWLQGIIRTSGLNTIVSGHCISSCSIMQSGGVERYLAGDLPIVDSVQIHAASNSGKVIYTPSPRMTQIYTGNYGGGMDAGLLHKAMYEVVQPNGLLVFRDPARTTGTSVTFDPDGSGSKLESFPGQDIYNNRIITAKGYRDPGDTLSVTANVSGDINPGYLRTGRQLQTFVDDDFARWNTNWQSSYINLAQSIYNASSNGPQGIGANSVQDYQKDPYYKALLLSKLRLGDLDVSTLDDSMGVIRVTNGATWRTSATTGADFMLVDNGTIALEGGALRASEVRVMGAGMLVGNGDVAGTAMDLSALASGTRPSWREDGFNRLRVYGTLMPRGGDLVTHGYVNIMPGGKVLFDVTENGGAGSGRLRVGSFFDSKQTDGALVISKGAFLELNVAQGYYGQDFRRDLVQGPIYQGGFEDVVRLGDTGYSANITGGEVFRPRHNSLLSFNVKQTADGLWLTANPGFDQLGLFANAVSGDALGRALATASDRKDGGLKSLLGALQFADRDVIAQQAGALRGDAHASLRLADNALVGSIGNVVQQHQAAMRSGGDADGLASQAAQSVSAQPGMRHGSLFNQLAMHLVEPAAGGGEGSGSGRNHGLWARGFASHGRIDADGGVAGLSHNIGGVVVGADTRVADDRVTLGVSVAAADMSTKGRDGSDFSGDVRALDVGGYLDATYSRGYLSAAVRYTDLRHDTRRSVSGIDGLQQPLRAKYNNDAISARVEHAFSFTTGKGLVIQPLLPVVDYARTSATRFNEGQGAGALVGRSGSLESIRVGAGLQLFRTFEGDNGERITPRARVVWQKELGDSQARYSTGFAAAPDLVFGASSQAVGEQVLAWNLGVTSRASERLSIMADYVGERRDGQIQNGVMLGLGYRF

SEQ ID NO: 379 - protein, 957 aa, Stenotrophomonas Sp.
MKHSKLSLALAGLIGVGATAAVDDVMAMNYHVQGDRIFLSGGVTYADVVSLPALLAKAQAEGRPIREVVLRTSNGGALIAGEWLQGIIRTSGLNTIVSGNCISSCSIMQSGGVERYLAGDLPIIDSVQIHAASNGGKVIYTPSPRMTQIYTGNYGGGMDAGLLHKAMYEVVQPNGLLVFRDPARGTGPSVTFDPDGSGSKLESFPGQDIYSNRIITASGYRDPGDTLNVSANVSGDINPGYLRTGRQLQTFVDDDFARWNTNWQSSYINLAQSIYNASSNGPQGIGANSVQDYQNDPTYKALLLSKLRLGDLDVSTLDNAMGVIRVTNGATWRTSATTGADFMLVDNGTIALEGGALRASEVRVMSAGMLVGHGDVAGTAMDLSALASGTRPSWREDGFNRLRVYGTLMPRGGDLVTHGYVNIMPGGKVLFDVTENGGTGGGRIRVGSFFDSRQTDGALVISKGAFLELNVAQGYYGQDFRRDLVQGPIYQGGFEEAVRLGDTGYRASITGGEVFRPRHNSLLSFNVKQTADGLWLTANPGFDQLGLFANGTSGDGLGRALATASDRQDSSLKSLLGALQFADRDVIAQQAGTLRGDAHASLRLADNALVGSIGNVVQQHQTATRSGGDADGLASQVAQSVSSQPGMRHGSLFNQLAMHLVEPASGSAAGSGDAGRSHGIWARGFASHGRIDADGGVAGLSHNIGGIVIGADTRVADDRVTLGVSVAAADMSTKGSDGSDFSGDVRALDVGGYLDATYSRGYLSAAVRYTDLRHDTRRSVSGIDGLQQPLRAKYSNDAISARVEHAFSFTTGKGLVIQPLLPVVDYARTSATRFNEGQGAGALVGRSGSLESIRVGAGLQLFKTFEGNNGERITPRARVVWQKELGDSQARYSTGFAAAPDLVFGASSQAVGEQVLAWNLGVTSRASERLSIMADYVGERRDGQIQNGVMLGLGYRF

SEQ ID NO: 380 - protein, 957 aa, Stenotrophomonas Sp.
MKHSKLSLALAGLIGVGALAAADDVMAMSYHLQGDRIFLSGGVTYADVVSLPALLAKAQAEGRPIREVVLRTSNGGALIAGEWLQGVIRTAGLNTIVSGHCISSCSIMQSGGVQRYLAGDLPIVDSVQIHAASSGGKVIYTPSPRMTQIYTGNYGGGMDAGLLHKAMYEVVQPNGLLVFRDPARTTGASVTFDPDGSGSKLESFPGQDIHSNNIITANGYRDPGDTLNVSANVSGDINPGYLRTGRQLQTFVDDDFARWNTNWQSSYINLAQSIYNASSRGPQGIGPDSVQDYLNDPGIQALLLSKLRLADLDVSTLDNAMGVIRVSNGATWRTAATTGADFMLVDNGTIALEGGALRASEVRVLGAGMLVGHGDVAGTAMDLDALGSGSGPSWREDGFNRLRVFGTLMPRGGDLVTHGYVNIMPGGKLLFDVTENGGAATGRLRVGTFFDDEPTDGALVISKGAFLELNVAQGYYGQDFRRDLVQGPIYQGGFEDVVRLGDTGYSASITAGDVFRPRHNSLLSFNVKQTADGLWLTANPGFDQLGLFANATSGDGLGRALATASARQDGNLKSLLGALQFADRDVIAQQAGALRGDAHASLRLADNALVGSIGNVVQQHQAAMRSGGDADGLASQAAQSVSAQPGMRHGSLFNQLAMHLVEPASGSAAGGGDAGRNRGIWARGFASHGRIDAEGGVAGLSHNIGGIVVGADTRVADDRVTLGVSVAAADMSTKGRDGSDFSGDVRALDVGGYLDATYSRGYLSAAVRYTDLRHDTRRSISGIDGLQQPLRAKYNNDAISARVEHAFSFTTVTGLVIQPLLPVVDYARTSATRFNEGQGAGALVGRSGSLESIRVGAGLQLFKTFEGNNGERITPRARVVWQKELGDSQARYSTGFAAAPDLVFGASSQAVGEQVLAWNLGVTSRASERLSIMADYVGERRDGQIQNGVMLGLGYRF

SEQ ID NO: 381 - protein, 957 aa, unknown
  environmental sample
MKYSKLSLALAGLMGVATMSVADDVMAMNYHVLGDRIFLSGDVTYADVVSLPALLAKAQAEGRPIREVVLRTSNGGALIAGEWLQGVIRTSGLNTIVSGNCISSCSIMQSGGVERYLAGDLPIIDSVQIHAASSGGKVIYTPSPRMTQIYTGNYGGGMDAGLLHKAMYEVVQPNGLLVFRDPARSTGASITFDPDGSGSKLESFPGQDIYSNRIITANGYRDPGDTLNVSANVSGDINPGYLRTGRQLQAFVDDDFARWNTDWQSTYINLAQSIYNASSRGPQGIGPLSVQGYLNDPDIQDLLLSKLRLADLDASTLDNAIGVIRVTNGATWRTSATTGADFMLVDNGTIALEGGALRASEVRVLGAGMLVGHGDVAGTAMDLNALGEGTGPSYREDGFNRLRVFGTLMPRGGDLVTHGYVNIMPGGKVLFDVTEGGGTATGRLRVGTFFDDEQTDGALVISKGAFLELNVAQGYYGQDFRRDLVEGPIYQGGFEEAVRLGDTGYSASITGGDVFRPRHNSLLSFNVKQTADGLWLTANPGFDQVGLFANGTSGDGLGRALATASDRQDKGLKSLLGALQFADRDVIAQQAGALRGDAHASLRLADTALVGSIGNVVQQHQAAMRSGGDADGLASQAAQSVSSQPGMRHGSLFNQLAMHLVEPASGSAAGSGDAGRNHGIWARGFASHGRIDADGGVAGLSHNIGGIVIGADTRVADDRVTLGVSVAAADMSTKASDGSGFTGDVRALDVGGYLDATYSRGYLSAAVRYTDLRHDTRRSIGGIDGLQQPLRARYSNDAISARVEHAFSFTTGKGLVIQPLLPVVDYARTSATRFNEGQGAGALVGRSGSLESIRVGAGLQLFKTFEGNNGERITPRARVVWQKELGDSQARYSTGFAAAPDLVFGASSQAVGEQVLAWNLGVTSRASEPLSIMADYVGERRDGQIQHGVMLGLGYKF

SEQ ID NO: 382 - protein, 956 aa, Stenotrophomonas Sp.
MKYSKLSLALAGLMGVAAISVVDDVMAMNYHVQGDRIFLSGDVTYADVVSLPALLAKAQAEGRPVREVVLRTSNGGALIAGEWLQGIIRTSGLNTIVSGNCISSCSIMQSGGVERYLAGDLPLIDSVQIHAASSGGKVIYTPSPRMTQIYTGNYGGGMDAGLLHKAMYEVVKPNGLLVFRDPARSTGSSVTFDPDGSGSKLESFPGQDIYSNRIITASGYRDPGDTLNVTANVTGDINPGYLRTGRQLQAFVDDDFARWNTDWRSTYINLAQSIYNASSKGPQGIGALSVQGYLSDPDIQDLLLSKLRLADLDVSTLDNAMGVIRVTNGATWRTSATTGADFMLVDNGTIALEGGALRASEVRVLGAGMLVGHGDVAGTAMDRAALLDGTGPSYREDGFNRLRVFGTLMPRGGDLVTHGYVNIMPGGKVLFDVTENGGTAAGRLRVGTFFDDEQTEGALVISKGAFLELNVAQGYYGQDFRRDLIEGPIYQGGFEEAVRLGDTGYSASISGDVFRPRHNSLLSFNVKQTADGLWLTANPGFDQLGLFANGTSGDGLGRALATASDRQDKGLRSLLGALQFADRDVIAQQAGALRGDAHASLRLADTALVGSIGNVVQQHQSAMRSGGDADGLASQVAQSVSSQPGMRHGSLFNQLAMHLVEPAPGSVAGSGDAGRSHGIWARGFASHGRIDADGGVAGLSHTIGGIVIGADTRVADDRVTLGVSVAAADMSTKASDGSGFTGDVRALDVGGYLDATYARGYLSAAVRYTDLRHDTRRSIGGIDGLQQPLRAKYSNDAISARVEHAFSFTTGKGLVIQPLLPVVDYARTSATRFNEGQGAGALVGRSGSLESIRVGAGLQLFKTFEGNNGERITPRARVVWQKELGDSQARYSTGFAAAPDLVFGASSQAVGEQVLAWNVGVTSRASERLSIMADYVGERRDGQIQNGVMLGLGYRF

SEQ ID NO: 383 - protein, 957 aa, Stenotrophomonas Sp.
MKHSKLSLALAGLMGVTAMAAVDDVMAMNYHVRDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGKITYAPSARMTQIYTGNYGGGMDAGLLHKAMYEVVQPNGLLVFRDPARTTGTSVTFDPDGSGSKLESFPGQDIRGNNIINTAGYRDPGDTLRVTSNVSGDINPGYLRTARQLQAFVDDDFARWNTDWASTYINDAVSLYNVSTRGANGIGAQSLQQLLADPDVQNELRGQLRLADLDASTLASSAGVIRVSNGATWRTAATTGADFILVDNGTIALEGGALRTPELRVMPGSIVVGHGDIASVGTDSDALLDGTGPSYREDGFNRLRVFGTLMPRGGDLVTHGYVNIMPGGQVLFDVTETGGTGSGRLRVGSFYDGGSEEGALVIAQGAHLALNVAQGFYAGTYRRDLVEGPIYQGGFQDAVRLGDAGYSASVTAGEVFRPRHNSLLSFNVNQTADGLWLTANPGFDQLGLFANGTSGDGLGRALAAASDRQDSGLKSLLGALQFADRDVIAQQAGALRGDAHASLRLADNALIGSIGNVVQQHQAAMRSGGDADGLASQAAQSVSAQPGMRHGSLFNQLAMHLVEPAGEAAGDSGVAGRSHGLWARGFASHGRIDADGGVAGLSHTVGGIVIGADTRVADDRVTLGVSVAAADMSTKASDGSGFSGDVRALDVGGYLDATYSRGYLSAAVRYTDLRHDTRRSVSGIDGLQQPLRAKYSNDAISARVEHAFSFTTGKGLVIQPLLPVVDYARTSATRFNEGQGAGALVGRSGSLESIRVGAGLQLFKTFEGNNGERITPRARVVWQKELGDSQARYSTGFAAAPDLVFGASSQAVGEQVLAWNVGVTSRASDRLSIMADYVGERRDGQIQNGVMLGLGYRF

SEQ ID NO: 384 - protein, 957 aa, Stenotrophomonas Sp.
MKHSKLSLALAGLIGITAITAVDDVMAMNYHVQDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGRITYAPSARMTQIYTGNYGGGMDAGLLHKAMYEVVQPNGLLVFRDPARTTGTSVTFDPDGSGSKLQSFPGQDIRSNTIINTVGYRDPGDTLRVTSNVSGDINPGYLRTARQLQAFVDDDFARWNTDWASTYINYAVSLYNVSTRGPNGIGAQSLQQLLADPDLQDALRGQLRLADLDASTLASSAGVIRVSNGATWRTAETTGADFMLVDNGTLALEGGALRTPELRVMPGSIVVGHGDIASVGVDTDALLDGTGPSYREDGFNRLRVFGTLMPRGGDLVTHGYVNIMPGGQVLFDVTEAGGTGSGRLRVGSFHDGGAEAGALVIAQGAHLALNVAQGFYPGAYRRDLVEGPIYQGGFQDVVRLGDAGYSASITAGDVFRPRHNSLLSFNVNQTADGLWLTANPGFDQLGLFANGTSGDGLGHALAAASDRQDSGLKSLLGALQFTDRDVIAQQAGALRGDAHASLRLADNALLGSIGNVVQQHQAAMRSGGDADGLASQAAQSVSAQPGMRHGSLFNQLAMHLVEPAGEAAGDSGVAGRSRGLWARGFASHGRIDAEGGVAGLSHTVGGIVVGADTRVADDRVTLGVSVAAADMSTKASDGSGFSGDVRALDVGGYLDATYSRGYLSAAVRYTDLRHDTRRSLSAIEGLQQPLHARYSSDAVSARVEHAFSFTTGKGVVIQPLLPVVDYARTSATRFNEGQGTGALVGRSGSLESIRVGAGLQVFRTFEGNNGERITPRARVVWQKELGDSQARYSTGFAAAPDLVFGASSQAVGEQVLAWNLGVTSRASERLSIMADYVGERRDGQIQNGVMLGLGYRF

SEQ ID NO: 385 - protein, 957 aa, Stenotrophomonas Sp.
MKHSKLSLALAGLIGITAITAVDDVMAMNYHVQDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGRITYAPSARMTQIYTGNYGGGMDAGLLHKAMYEVVQPNGLLVFRDPARTTGTSVTFDPDGSGSKLQSFPGQDIRSNTIINTAGYRDPGDTLRVTSNVSGDINPGYLRTARQLQAFVDDDFARWNTDWASTYINYAVSLYNVSTRGPNGIGAQSLQQLLADPDLQDALRGQLRLADLDASTLASSAGVIRVSNGATWRTAETTGADFMLVDNGTLALEGGALRTPELRVMPGSIVVGHGDIASVGVDTDALLDGTGPSYREDGFNRLRVFGTLMPRGGDLVTHGYVNIMPGGQVLFDVTDAGGAGSGRLRVGSFHDGGAEAGALVIAQGAHLALNVAQGFYPGAYRRDLVEGPIYQGGFQDVVRLGDAGYSASITAGDVFRPRHNSLLSFNVNQTADGLWLTANPGFDQLGLFGNGTSGDGLGRALAAASDRQDSGLKSLLGALQFTDRDVIAQQAGALRGDAHASLRLADNALLGSIGNVVQQHQAAMRSGGDADGLASQAAQSVSAQPGMRHGSLFNQLAMHLVEPAGEAAGDSGVAGRSRGLWARGFASHGRIDAEGGVAGLSHTVGGIVVGADTRVADDRVTLGVSVAAADMSTKASDGFGFSGDVRALDVGGYLDATYSRGYLSAAVRYTDLRHDTRRSLSAIEGLQQPLHARYSSDAVSARVEHAFSFTRGKGLVIQPLLPVVDYARTSAIRFNEGQGTGALVGRSGSLESIRVGAGLQAFRTFEGNNGERITPRARVVWQKELGDSQARYSTGFAAAPDLVFGASSQAVGEQVLAWNLGVTSRASERLSIMADYVGERRDGQIQNGVMLGLGYRF

SEQ ID NO: 386 - protein, 962 aa, unknown
  environmental sample
MKHSKLSIALAGLVGIATLGQMDDVMAMNYHVQGDRVVLSGGVTVADVVALPALLAKAQAEGRPIREVVLRTSNGGALIAGEWLQGVIRTNGLNTIVSGHCISSCSIMQSGGVERYLAGDLPLVDSVQIHAASNSGKVIYTPSPRMTEIYTGNYGGGMDAGLLHKAMYEVVQPNGLLVFRDPARTTGASVSFDPDGSGRRLETFPGQDIYSNNIITAAGYRDPGDTLTVTGNVSGDINPGYLRTARQLQAFVDDDFARWNDTDFATTYINYAVNIYNRSSAGPNGIGPASVQDYLNDPGTQQLLLGQLRLDELDASTLGNSAGVIRVAKGGTWRTAETTGADFMLVENGTIALEGGALRTPELRVLAAGMVVGHGDIASVATDSNALLDGTGPSYREDGFNRLRVYGTLMPRGGDLVTHGYVNIMPGGKVLFDVTEAGGSQAGRLRVGDFYDSGANEGALVISPGAHLELNVAQGFYAGNYQRELVSGPIYQGGFTDAVRLGDTGYTASITDGEVFRPRHNSLLSFNINQTAEGLSLTANPGFDQLAQLTGNNGNDGLGRALATAGQRQDAGLKPLLGALQFADRDVIAQQAGALRGDGHASLRLADNALVGSIGSVVQQHQAARRSGSGDAGGLAAQAAQAASAQPGMANGSLFNQLAMHLVEPAGAGGGSTNFGGEAPRSHGLWGRGFGSHGRIDGEGGVAGLSHTVGGIVLGADTQLADDRVTLGVSVAAADMSTKGRDGSGFSGDVRALDVGGYLDATYSRGYLSASVRYTDLRHDTRRSIDGIDGLQGPLRAKYNNDAISARLEHGFSFTTAKGVVIQPLLPVVDYARTSATRFNEGQGAGALVGRGDSLESIRVGAGLQVFKTFEGNNGERITPRARVVWQKELGDTQARYSTGFAAAPDLVFGASSQTVGEQVLAWNLGVTSRATDRLSVMVDYVGERRDGQLQNGVMLGLGYTF

SEQ ID NO: 387 - protein, 996 aa, Stenotrophomonas Sp.
MAPDSIVNAFMFRGLVRWGSFRRPDVELLTRVLRVEREHMKHSKLSLALAGLMGVTAMAAVDDVMAMNYHVRDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGRITYAPSPRMTQIYTGNYGGGMDAGLLHKAMYEVVQPNGLLVFRDPARTTGTSVTFDPDGSGSKLETFPGQDIRGNNIINTAGYRDPGDTLRVTSNVSGDINPGYLRTARQLQAFVDDDFARWNTDWASAYINYAVSLYNVSTRGPNGIGTQSLQQMLADPDLQDELRGQLRLADLDASTLASSAGVIRVSNGATWRTAETTGADFMLVDNGTIALEGGALRTPELRVMPGSVVVGHGDIASVGTDSDALLDGTGPSYREDGFNRLRVFGTLMPRGGDLVTHGYVNIMPGGQVLFDVTETGGTGSGRLRVGSFYDGGSEEGALVIAQGAHLALNVAQGFYAGTYRRDLVEGPIYQGGFQDAVRLGDTGYSASIAAGEVFRPRHNSLLSFNVNQTADGLWLTANPGFDQLGLFTNGTSGDGLGRALAAASDRQDSGLKSLLGALQFADRDVIAQQAGALRGDAHASLRLADNALIGSIGNVVQQHQAAMRSGGDADGLASQAAQSVSSQPGMRHGSLFNQLAMHLVEPAGEGAGDSRTASGSRGLWARGFASHGRIDADGGVAGLSHDVGGIVIGADTRVADDRVTLGVSVAAADMSTKASDGSGFSGDVRALDVGGYLDATYSRGYLSAAARYTDLRHDTRRSVGGIDGLQQPLRAKYSNDAISARVEHAFSFTTGKGLVIQPLLPVVDYARTSATRFNEGQGAGALVGRSGSLESVRVGAGLQLFKTFEGNNGERITPRARVVWQKELGDTQARYSTGFAAAPDLLFGASSQAVGEQVLAWNLGVTSRASERLSIMADYVGERRDGQIHNGVMLGLGYRF

SEQ ID NO: 388 - protein, 1008 aa, Streptomyces Sp.
MSQHQFLRARRLLTSLLTGAVLVGGLLAAPASSAASGASDISADIPPQEPGVTLRVFDVQTPLSKLCTLKPGQTPNYDAVKATVDWSTTDDFGGFSDRFVTEVTGNLVVPSDGIYALRLISDDGSRLTIDDTTIVDHDGLHGAEPKDGSVSLTAGSHPLRIDHFERDGGQQLQLAWKPPGAADFTVVPREALTTDAGVVRVTAPGRKECEGSGDTPGDGLPLTEVRPDLTLTDLRPDGFEPQVTGMDWLPDGRLAISTWGGSDNLAGEVYLLDNVTGETSKDKVTVKKVASGLREPMGIKYVDGSLYVSQKHELTRLVDRNRDDVADEYRTVATFPYGGNFHEFAFGLLYRDGYFYVNLSVSINLGGATTVPQPAPGRGTTYKVSKKTGKISPIAGGLRTPNGIGWGPEGELFATDNQGGWLPSSKLIQVKQGRFFNHYTEPSGAFDAAQPTNPVLWLPQNEIANSPSTPLYVKKGTFAGQMLIGDVTYGGLQRAYLEKVKGQYQGAVFRYTQGLEAGVNRLTLGPDGSIYAGGLGADGNWGQEGKLRFGLQKLTPNGGNTFDIKTMRAVPGGFDLTYTQPVSAKTAEELAKHYRAEQWRYTPTSDYGGPKIAEEVLPVRSAELSKDARTVRLRLDGLKEGRVVHLRSPRPFTSESGESLWNTEAWYTLNAMPGKQPPPATQYEAEEARLTGTAGVATDHVGHSGSGFVARYNTEGKAATTFDVKVRKSGTYDVNLRYSNGPNPFQGTKSLTLYANGKKLRQVKLASTSDWDSWSTQTEAVKLRAGNNTLSYRFDAGDTGHVNLDLITLRKHGAPLALFDGTAASQSQWQHTDGRRLEWPLADEKSMEVCCGDIRTIDAYQDFKLHAEFRVPLLPADVTGQNRGNSGIFIQDRYELQILDSYGDTSLDTNEAGAIYLKKAPDVNAAKAPETWQTYDIVFRAARFDDSGNKTADARLTVVWNGQKVHDDITLDGPTASGRAETPSAGAIRLQDHGNKVRFRNIRLEPLS

SEQ ID NO: 389 - protein, 1002 aa, Streptomyces Sp.
MSHHLFLRARRLVTSLATGAILAGGLWAAPSSSAAPSDIPPQEPGVTLRVFDVQTPLSKLCTLKPGQTPNHDSLKSTVDWSTADDFGGFSDRFVTEVTGYLVVPSDGTYGFRLTSDDGSRLTIDDTTVVDHDGLHGAEPKDGAVTLTAGSHPLRIDHFERDGGQQLQLAWKPPGESDFAVVPREALTTDADVVRVTAPGRKECEASGDSPGDGLPLTSVRPDLTLTDLRPDGFEPQVTGMDWLPDGRLAISTWGGSDNVAGEVYLLDNVTGPTSKDKVTFKKVASGLREPMGIKYVDGSLYVSQKHELTRLVDRNRDDVADEYRTVATWPYGGNFHEFAFGLLYRDGYFYVNLSVSINLGGATTVPQPAPGRGTTYKVSKKTGKISPVAGGLRTPNGIGWGPDGELFATDNQGGWLPSSKLVHVKQDRFFNHYTEPSGPFDAATPTNPVLWLPQNEIANSPSTPLYVKKGRFAGQMLIGDVTYGGLQRAYLEKVKGQYQGAVFRYTQGLEAGVNRLTLGPDGSIYAGGLGAEGNWGQEGKLKFGLQKLTPNGGNTFDIQTMRAVPGGFDLTYTQPVSATTAEELAKRYRAEQWRYTPTTDYGGPKIAEEALPVRSAELSKDGRTVRLRLDGLKSGRVVHLRSPRPFTSASGEALWSTEAWYTLNAMPGKQPPPATQYEAEEARLTGSAGINTDHVGHSGSGFVDRYSTEGKVATTFDVTVPKAGTYDVNLRYSNGPNPFQGTKSLSLYTNGKKLRQVKLASTGDWDSWSTQTEPVVLRAGKNTLSYSYDPGDTGHVNLDLITVRPHAAPVTLFDGSAASQAEWQHTDGRRLKWPLTDEESMEVCCGDIRTLDAYQDFKLHVEFRVPLLPPDVTGQDRGNSGIFIQDRYELQILDSYGDTSLDTNEAGAIYLKKAPDVNAAKAPETWQTYDIVFRAARYDDSGNKTADARLTVVWNGEKVHDDIALDGPTASGRAETPAAGAIRLQDHGNKVRFRNIRLEPLA

SEQ ID NO: 390 - protein, 1002 aa, Streptomyces Sp.
MPHRLFPRVRRHLVPLLAGAFLAGGLCSAPPASAAPADLPPQEPGVTLRVFDVQTPLSRLCTLKPGQTPNHDRLMPTVDWSTEADFGGFSDHFVTETSGYLNVPEDGSYAFRLTSDDGSRLTIGGDTVIDHDGLHGSEPKDGTVHLTAGPHPLRIDHFERDGGQRLQLAWRPPGESDFAVVPREALSTDAGVVRVTAPGRKECEASGDSPGDGLPLTSVRPDLTLTDLRPDGFEPQVSGMDWLPDGRLAISTWGGTDNVAGEVYLLDNVTGRTSREKVTVRKVASGLREPMGVAYVDGSLYVSQKHELTRLVDKDRDGVTDEYRTVATWPYGGNFHEFAFGLLYRDGYFYVNLSVAIDLGGATTTPQPAPGRGITYKVSKKTGRISPVAGGLRTPNGIGWGPGGGLFATDNQGGWLPSSKLVQIEQGRFYNHYTEPPGAFDDSPVTEPVLWLPQNEIANSPSTPLYLKKGTFAGQMLLGDVTYGGLQRAFLEKVKGQYQGAVFRYTQGLEAGVNRITLGPDGAIYAGGLGADGNWGQEGKLRFGLQKLTPNGKNTFDIRSMRAVPGGFDLTYTQPVSAATAEQLAARYRAEQWRYTPTADYGGRKIAEEPLPVRSATLSKDGRTVKLRLDGLKPGRVVHLRSPRPFTSASGEALWSTEAWYTLNRMPGKQPPPATRYEAEEARLTGTAGINTDHAGHSGSGFVDRYATEGKVATTFDVTVPKTGAYDVGLRYSNGPNPFRGTKTLSLYANGKKVRQTELAPTGDWDSWSTRTEKLTLRAGHNTLSYRYDPGDTGHVNLDLITVRPHGARVTLFDGTAASQAQWQHTDGRRLRWPLTDEKSMEVCCGDIRTLDAYQDFRLHVEFRVPLLPPDVTGQDRGNSGIFLQDRYELQILDSYGDTSPGTDEAGAIYLKRAPDTNAATAPGTWQTYDVVFRAARYDDSGRKTADARVTVVWNGEKVHDDVALDGPTASGRAESPAAGAIRLQDHGNEVRFRNIRITPLA

SEQ ID NO: 391 - protein, 1002 aa, Streptomyces Sp.
MHPRLFSRARRHLILLLTSAVALGGAWAAPASSAAPADIPPQEPGVTLRVFDVQTPLNELCTLKPGQTPNHDKLMPTVDWSTTADFGGIADNFVSQASGYLVAPRDGTYVFRLVSDDGSRLTLDGATVIDHDGLHGAEPKDGTAELTAGAHPLRIDHFDRGGGQQVQLSWMPPGESGFTVVPTEALSTDAGVVRVTAPGRKECEAGRDTPGDGLPLTSVRPDLDLTDLRPEGFEPQVTGMDWLPDGRLAISTWGGTDNVAGEVYLLDNVTGETSRDKVTVEKVASGLREPMGIKYVDGSLYVSQKHELTRLVDSDGDDVTDEYRTVATWPYGGNFHEFAFGLLYRDGYFYVNLSVAIDLGGATTNPQPAPNRGTTYKISKKTGKISPIAGGLRTPNGIGWGPGGSLFATDNQGGWLPASKLVQIKQDRFFNHYTEPAGPFEDSPVTEPVLWLPQNEIGNSPSTPLYLTKGRFAGQLLIGDVTYGGLQRAYLEKVKGQYQGAVFRYTQGLEAGVNRVSMGPDGAIYTGGLGADGNWGQEGKLKFGLQKLTPNGGNTFDVQKMRAVPGGFDLTYTQPVSEATAAELASRYEAEQWRYTPTGDYGGPKIAEEELAVRSATLSDDGRTVRLRLDGLKPDRVVHVRSPRPFTSASGETLWSTEAWYTLNEMPGKQPPAATLYEAEEARLTGKAGINTDHIGYSGSGFVDRYATEGDVTTTFDVTVPRAGTYDVGLRYSNGPNPFEGTKSLSLYAGGKKVRQTQLPSTGDWDTWSTRTESVRLRAGHNTVSYRYDPGDTGHVNLDLITVRPHGARVALFDGTAASQEQWQHTDGRKAAWPLAEERSMEVCCGDIRTKDAYQDFKLHVEFRVPLLPDDVTGQDRGNSGIYLQDRYELQILDSYGDTTLDTNEAGAIYLKKAPDTNAATAPETWQTYDIVFRAARFDENGAKTADARVTVVWNGETVHDDVALDGPTAAGRAETAAAGAIRLQDHGNKVRFRDIRVEPLN

SEQ ID NO: 392 - protein, 1003 aa, Streptomyces Sp.
MRPRLFRRARRHLVLLLASAVSAGGLLAVPATAASAAADVPPQEPGVTLRVFDVQTPLSKICTLKPGQTPNHDKLMPRVDWSSTADFGGIADNFVSEATGYLIAPRDGTYAFRLTSDDGSRLTLDGTTVIDHDGLHGAEPKDGALDLTAGSHPLRIEHFDRGGEQQLTLSWRPPGETGFTVVPNSALTTDAGVVRVTAPGRKECEAGNDTPGDGLPLTSVRPDLTLTDLRPEGFEPQVTGMDWLPDGRLALSTWGGTDNVAGEVYLLDNVTGATSRDKVTVKKVAEGLREPMGIKYVDGSLYVSQKHELTRLVDENDDDVTDAYRTVATWPYGGNFHEFAFGLLYRDGHFYVNLSVAIDLGGATTTPQPAPNRGTTYKISKKTGKITPIAGGLRTPNGIGWGPGGGLFVTDNQGGWLPASKLVQIKQDRFFNHYTEPAGPFEDSPVTEPVLWLPQNEIGNSPSTPLYLNKGTFAGQMLIGDVTYGGLQRAYLEKVKGQYQGAVFRYTQGLEAGVNRITMGPDGAIYAGGLGADGNWGQAGKLKFGLQKLTPNGGDTFDIQKMRAVPGGFDLTYTQPVSDATAGELAARYDVQQWHYTPTADYGGPKIAEEELSVRSATLSKDGRTVRLRLDGLKPDRVVHVRSPRPFTSASGESLWSTEAWYTLNEMPGKQPPPATLYEAEEARLTGKAGINTDHVGYSGSGFVDRYATEGKVATTFDVKVPKSGTYDVGLRYSNGPNPFEGTKSLSLYANGKKVRQTQLPSTGDWDTWSTRTEPLRLRAGHNTVSYRYDPGDTGHVNLDLITVHPRGARVDLFDGTAASQAQWQHTDGRPVAWPLAEEESMEVCCGDIRTKDAYQDFKLHVEFRVPQLPPDVTGQDRGNSGIYLQDRYELQILDSYGDTTPATDEAGAFYLKKAPDTNAATAPETWQTYDIVFRAARYDDSGRKTTDARVTVVWNGEKVHDDVVLDGPTAGGRTETPAAGAIRLQDHGNKVRFRDIRVQPLS

SEQ ID NO: 393 - protein, 683 aa, Streptomyces Sp.
MTRTRLTALAATAALAATGGLITATPAAAAVTCASPLWRAQYFGNSTFSGTPKLTACDSAVAEDYGYGDPAGVTLPKDNFSVRWSLTRDFGSGGPFRLSAATQDGMRVYVDGVRKIDLWKNVSTTARKTVDLTVPAGKHTLRVDYVAWTGVARAAFTYAPRTEAAVDAVKPLAPTGLTAAYNRDTSKTTLRWTANKEMDLAGYRVYRRLSTTSWARVSGASLLTSRSFVDATPATGQTFLYEVRAVDKAGRESAGSLDAPAVTVDRTGPAAPTALTVVGDAWWATLAWHQVADATTYEVYASAAAGGPFELLGTTSTTSYRTDAPENTARYYRVRALDALGNPSAYAAVTGDGVDRTPPKSPTSLGSVVGVGDTEVYWKQPDGFHEDFDNGGAYHVYRSPGTTLDPAALTRVTCAEESDETSTGGLCHDLDMPAGTYVTYAVVAVDPAGNESALSAPLVVRTGDRVPPGPVTGVKATPRADGVLVSWAASSEDDVERYVAWTGARQADGTVKWLGSASCREGTSDPLAVLCGDLPDGETYVYAVVARDRWGNALLPSDPRVTLVEATELDVRPELTVTRDWDLGSMGYGTVIGGPDEDGPSISWRCDKTAECDSVAGYRVSRWNAATKAYEPLHAGLLPSQTRAYTDTTAARGTTHFYTLEAVRADGGIAGTHVWNCVFQDRV

SEQ ID NO: 394 - protein, 696 aa, Streptomyces Sp.
MFPIGPEGAPLSVMTRTRLTALAATATLAATGGLITASPASAAVTCTSPVWKAQYFGNSTFSGTPKLTACDSAISENYGYGDPAGVTLPKDNFSVRWSLTRDFGSGGPFRLSAATQDGMRVYVDGVRKIDLWKNVSTTARKTVDLTIPAGKHTIRVDYVAWTGLANAAFTYAPRTEAAVDKVNPLAPTGLTAAYNRDTTKTTLRWAANKEMDLAGYRVYRRLSTTQWAKAGGPSLVTSPSFVDATPATGQTFLYEVRAVDKAGRESAGSPDATAVTVDRTGPAAPTGLTVTSDAWWATLAWHGGADAAKYEVYAASAAAGPFTLLGTTTTTSYRTDAPMNTARYYRVRALDALGNPSAYATVTGDGVDRTPPKSPTSLGSVVRPGSTEVFWKQPDGFYEDFDNGGTYHVYRSPGKTLDPAALTRVTCAEGSDETSADGKCYDLGMPAGTYVTYAVVAVDPAGNESTLSAPHVVRTGDRVAPGPVTGVKATPRADGVLVSWAASTDDDVESYVVRNGTRQADGTVKWLGTSSCWEGTSDPLAVLCGDVPDGETYVYSVVARDRWGNALLPSDPKVTVVEATELDVRPSVTVTRDWDLGSVGYVTLIGGPGVKGPSINWECTKTAECDTVAGYRISRWNAATKAYEPLHTGLLPTDTRAYTDTTAVQGATYFYTLEAVRADGSVAGTHVWGCVFQDRV

SEQ ID NO: 395 - protein, 683 aa, Streptomyces Sp.
MTRTRLIALAATAALAATGGLITAAPASAAVTCASPVWKAQYFGNSTFSGTPKLTACDSAVAENYGQGDPPGVTLPKDNFSVRWSLTRDFGSGGPFRLSAATQDGMRVYVDGVRKIDLWKNVSATARKTVDLTVPAGKHTIRVDYVAWTGLASAAFTYAPRTEATVDTVKPLAPAGLTAAYSRDSTKTTLRWTANKEMDLAGYRVYRRLSTTSWAKASGTSPLTSPSFVDATPATGQTFLYEVRAVDKAGRESAGGPDATVATVDRTGPAAPAGLTVTGDAWWATLAWRGVADAAKYEVYAAPKATGPFELLGTTASASYRTDAPPNTARYYRVRALDALGNPSAYATVTGDGVDRTPPKSPTSLGSVVGADYTKVYWKQPDGFYEDFDNGGTYRVYRSPGRTLDPAALTRVTCAEESDETSTDGICHDLGMPAGTYVTYAVVAVDPSGNQSALSAPLVVRTGDRVAPGPVTGVKATPRADGVLVSWTASAEDDVERYDVWTGARQADGTVKWLGTNFCAEGTSDPLAVLCGDLPDGETYVYAVLARDRWGNGLRPGDPKAVVVEATELDVRPSVTVTRDWDLGSMGYGTVIGGPGQDGPSISWRCDRTAECDTVTGYRVSRWDPAAKAYRPLHAEPLPAQTRAFTDTTATRGTTYFYTLEAVRADGGVAGTHTWNCVFQDRV

SEQ ID NO: 396 - protein, 632 aa, Streptomyces Sp.
MGHSRRIRRAKYAALTGMASLALAAAGLAGVAGPASAQDISGSTGSAGNEFNPWSPQAGHPYRHGAVPGMSQHENYKKWLAEHNQAAATGQQTLSYGGGVDGIGVQSGHSKVYLIFYGNQWGTQTTDANGNAKFSGDSAGAAGATQQMFKGIGTNGETWSADLTQWCDGPNVATGAVSCPSNANFIPYQSGGVLSGVWYDNAAASPSQATGNQLAQEAVKAAGHFGNTTAAANRDAYYIVLSPHGTNPDDYQNPTTGYCAWHDWNGDTTLTGGAASSPYGDIAFSNQPYNIDAGANCGVGFVNSPGTLDGWTMTLGHEWHEMMSDQNPAGGWTNHVSGSSYNGQENSDECAWIRPGSTGGAANISFGSFGSYAEQASWSNDTNSCAISHTILTHGNTVTVTNPGNQSGTVGTAASLQIAATDSASGQTLTYSATGLPAGLSINSSTGLISGTPTAAGTTSVTVTATDTTGAAGSTSFSWTESTTGGGGNAVTNGGFEAGSLTGWTAAGSTSATTGAAHTGSYGAMVGSTNPTGDSSIAQTFTAPTGSSKVSFWYSNTCDDTVTYDWATATLKDNTTGTTTTVLAKTCTTTGTWTNKTATVTPGHSYTLTLSNHDDNYPGDPTYTYYDDVTVS

SEQ ID NO: 397 - protein, 632 aa, Streptomyces Sp.
MGHSRRIRRAKYAALTGIASLALAAAGLAGAAGPASAQDISSSQGSSGSEFNPWSPQNGHPYRHGAVPGMSQHENYKKWLAAHNQAAATGQQTLSYGGGVDGIGVQSGHSKVYLVFYGNQWGSQTTDANGNAKFSGDSAGAAGATQQMFKGIGTNGETWSADLTQWCDGPAVATGAVSCPSNANFVPYQSGGVLSGVWYDNAAASPSQATGNQLAQEAVKAAGHFGNTTAAANRDAYYIILSPHGTNPDDYQNPSTGYCAWHDWNGDTTLTGGAANSPYGDIAFSNQPYNIDAGSNCGVGFVNSPGTLDGWTMTLGHEWHEMMSDQNPAGGWTNHVSGSSYNGQENSDECAWIQPGSTGGAANVSFGTFGSYAEQASWSNDTNSCAISHAILTHGNTVTVTNPGNQNGTVGTAASLQIHATDSASGQTLSYSATGLPAGLAINASTGLISGTPTAAGTSGVTVTVTDTTGATGSTSFSWTESTSGGGGNTVTNGGFENGNLTGWTAAGSTSATSAAAHSGSYGAMVGSTSPTGDSSLAQTFTAPTGSSKVSFWYSNTCDDTVTYDWATATLKDNTTGTTTTVLAKTCTTTGTWTNKTATVTPGHSYTLTLSNHDDNYAGDPTYTYYDDVTVS

SEQ ID NO: 398 - protein, 632 aa, Streptomyces Sp.
MGHSRSMRRARYATLTGIASLALAAAGLAGVAGPAAAQDIPGVASSTGNEFNPWSPQQGHPYRHGAVQGLQQHENYKKWLAAKNQAAATGQQTLSYGGGVDGIGVQSGHSKVYLVFYGTQWGTQTTDANGNAKFSNDSAGAAGATQQMFKGIGTNGETWSADLTQWCDGPNVAAGAVSCPSNANFIPYQSGGVLSGVWYDNSAASPAQASGHQLGVEAVNAAAHFGNTTAASNRDAYYIILSPHGTNPDDYQNPTTGYCAWHDWNGDTTLTGGAASSPYGDIAFSNQPYNIDQGTNCGVGFVNSPGTLDGYTMTLGHEWQEMMSDQNPAGGWTNHVSGSSYNGQENSDECAWIRPGSTGGAANISFGSYGTFAEQASWSNDTNSCAISHAILNHGNTVTVTNPGSQSGTVGTAASLQISASDSATGQTLTYSATGLPAGLSINSSTGLISGTPTASGTSSVTVTATDTTSATGSTSFTWTESTSGGGGNAITNGGFETGNTTGWTTTGTATAPAGAAHTGSYGLQLGSTSPTADSTAAQTFTAPTGSSKLSFWSKNTCPDTLTYDWATATLKDNTTNTTTTVLAKTCSAAGAWTNTTATVTPGHSYTLTLVNHDDNYAGDATYTSYDDVTVS

SEQ ID NO: 399 - protein, 828 aa, Saccharothrix Sp.
MSALPTRSALRTRWVGALTAAALAALGTGTLAATPAAAKHAGATYTISIGKTGSYAYPDDTPASVYTDKDGTFHLQQSHSLYGAKDSRQWDFYTGTDFDSATRSAAISDAVNPANPDDRNNDTTWRCNNSPTGLEASYAPAGSGYSQKNFCDLSGVWVDPDTGDWYGLVHNEFTPQPFGDGLHYDAIDYAVSTDQGKTWSIKDHVITSPYSTKRGDTAAFPQQTFYYGDGDQRLFVDTASGYFYVFYGSRIVDKGGSWGAFQQHVARAPISAKMSPDSWQKWYDGSWTQPGAGGLESDMVPADATNPTGYLAPAKEYDPTNPGTVKQQIAAGTLAPTTPLFVMNVSYDAYLGLYIGSPQAVDQSGNAPQQIYATKDLATQKWTLLGDTGGYHTASWYRWFLDSANRTDSTIVGKTFRTYCSIACAGSDGQYVDMTIGSSAPAAPPVDLRKTYRIQNGDGRVLAQADGGSGTTSTARPSGSARESWSFLADGDGAYRIANAATGQLLGVDSTATAGRAWGAGLTVTDAVGGNATVGQQWFILPSTAGKGGFQLVNRYSGLVIGLSGTADRLTETTPARSWTDATGSTVGGGRTADEQTLAFTPTGTAPETVVLNAPGDQSGTVGKAASVQLSATDNAGKPLTFSATGLPAGLSVSPSGLISGTPTAAGVATVTVTASSGTASASTSLTWTVTPALSGNHTLTTGGKALDDADNSTTAGNHLITWTTSGSSNQLWQFRPQPDGSYELVNGRSSMCADVTGGSTAAGAQVIQWPCSGGSNQHWNVRLTADGSYAVTSARSGLLLTTDSSADGAPVTQQPDTGSPLQRWSIS

SEQ ID NO: 400 - protein, 811 aa, Kitasatospora Sp.
MPPRPRALPTGLALLAVLAAQALGAAPAPAAAGTPLVDGGGYLLGSALDGSCLGPQYAQPAPGTPVVGAACGRLLSQRWQLRRAGTDYLLVNAASGRCLTLGGPDRRPATADCGSSPEAERFTVSRAPQGTYTLTTRGTGGCLTADPAPVAHHCDNRPAHRWTLTRTEPLVLADPGFEQSDTSDTSGTNGTSGTNGAATAGSTSDGWTFTPHTGTATNNPHGGTRLAYLDAGPGYAVSQQVTAVTAGSYDLSAWIATGGAGGSLSVSVNGTVVRSLPLPEQSLYAKYTLPRVRVAPGDRLTLTIGSSPTGWINVDDAAVAPAAPNDPVISSSDPEAVALFDWAKAKANSWVQQAGATSVLDQDENHPGGTGTTTYDATYWAGYPFRSAFYSRDFAHQLVGAHLLGLDAENKTMLRGFAASATEVNKLYPVWALNFDARSYGAIDYRSPDRFVRELPAPFELVQQTGEAYRWTGDRDYAEDPGLGRYVRNTLGPFITARPGPVDNGGVPIPQATSRSIFAGTASYAENATRTYAEAGDAVGAQYQAYLSAAALADARGDAASAAGYRKAAEQLRAYVNSTWSVDGSQPGEVVHGYDTAGKPITGWGYEASVLMPVKGLLDPGPRRDAQLAAIDAADSGPERSANLEAYTYLPDAFFANHDGSTAWKWMRHVYESVGEPHVSGAMLNGDYPEVPFTLLAQTVQGLLGVTPDAAGHALSTTPQLPASMGWLQVAGIPVGGGTVTVRHDGAQRSTVTNTGTEPVTWEARFPGQHARATVDGEQREARTTTVDGTTYTSITVTLAPGHSATATVTD

SEQ ID NO: 401 - protein, 426 aa, Streptomyces Sp.
MRHLRSTGRFGRELIAFTAAAASAIAAMSFAASPAAAAPAKPAAAQAKPGDTCTAADLGTRHPYIKSTEVSPTITHFKGWYVTEGTTGTQTVTTSTQTTISVSVGLNGNVEGSFAVETLGKVGASLGLNVKVDYTSTSTESNAVTWNFSQPGYYGAYKGTKKVTGTYGSLNCNRVQQGDGSWALKWIEGPDGGNFTTYTTLEEGAVRCQDEVPAGSIMAKAQGLLDCGSAAAKAEHPAGAVAPTAKQKRDRLVQRPALTSGTSAEQPKATGRSARAALDCKAEVYKIAVPGKPLSWGAPLLADDGVRLRPSSIFSAHLDNWRLCNVTENNGVLEASLWNWGNGGCATIAEQNAATEQAVLQTAPCTEDDLQRFYIYRDVPGSSKIGVQNKYTGSMMGHDRYADGEFIRQYSSGRQDGTGTYTLIGV

SEQ ID NO: 402 - protein, 425 aa, Streptomyces Sp.
MRPTKPVSRLGRALMACAASAAVATVGLAVSPASAAPAKSVAATQVKPGDVCTAADLGTRHPYIKTTEVTPEITHFKGWYVTQGATGYQSVTTSTQTTISVSVGLNGNVQGSFAVETLGTVGASLGLNVQVNYSSTSSESNTVTWNFSRPGYYGVYKGTKKVTGTYGSLNCNRVQQGSGGWALKWIEGPGSGSFTTYTTLEEGAVRCEDTVPANSIMAKAKGLLDCGSPAARAEHPAGAVAPTTKQTQDRLAQRPAPTSGTSAGQPKATGRSAQAALNCEPGVYKIDVPGKPLNWSAPLLANDGIRLRVSTFFSAHLDNWRLCNVTENNGVLEASLWNWGNGGCATIPANIANQEQAYLTTATCGEDDLQRFYIYRDVPGSSKIGLQNKYTGSMMGYDRYADGDLIRQYSSGRQDGTGTYTLTGV

SEQ ID NO: 403 - protein, 425 aa, Streptomyces Sp.
MRSIGPVSRIGRSLMVVTAMAAASAVSAMSLAAAPAAAAPTDTTAPQPGDTCTAADLGTRHPYIKTTEVSPTITHFKGWYVTEGTTGNQTVSTSMQTTISVSVGLNGNVESSFAVETLGKVGASLGLNVKVDYSSTSSVSNSVTWNFSQPGYYGVYKGTKKVTGTYGSLNCNRVQQGDGSWALEWIEGSGSGSFTTYTTLEEGAVRCQDSVPAGSITAKAQDLLDCGSAVAKAEHPAGAVAPTAKQKRDRLVQRPALTSGTSAEQPKATEPSARAALDCTAGAYKIAVPGKPLSWGAPLLADDGVRLRPSTIFSAHLDHWRLCNVTEHNGVLEASLWNWGNGGCATIAEQNAATERAVLMTAPCTEDDLQRFYVYRDVPGSSKVGVQNKHTGSMMGHDRYADGEFIRQYSSGRQDGTGTYTLIGV

SEQ ID NO: 404 - protein, 409 aa, Streptomyces Sp.
MTATAAAIAVTAMGLAASPAAAAPTDTTAPRPGDTCTAADLGTRHPYIKTTEVSPTITHFKGWYVTEGTTGNQTVTTSTQTTISVSVGLNGNVEGGFAVETLGKVGASLGLNVKVDYSSTSSESNSVTWNFNQPGYYGVYKGTKKVTGTYGSLNCNRVQQGSGSWALKWIEGPGGGSFTTYTTLEEGAVRCQDEVPAGSIMAKAQDLLDCGSAAAKAEHPAGAVAPTEKQKRDRAVQRPALTGGTSAEQPKAGGRSARAALDCQANVYKIAVPGKPLSWGAPVLAADGVRLRPSSIFSAHLDNWRLCNVTENNGVIEASLWNWGNGGCATIGAQNPATERAALMTASCTEDDLQRFYIYRDVPGSSKIGVQNKYTGSMMGHDRYADGEFIRQYSSGRQDGTGTYTLVGV

SEQ ID NO: 405 - protein, 429 aa, Streptomyces Sp.
MSRLRSSGRWARGLVALTVTAASTLATVTAVAGPAAATGHPKPATTADQPKLGDACTSADLGARHPYIKSTEVVPTITHFKGWYVTEGTTGNQTVTTTTQTTISVSVGLNGNLEGGFAVETLGKVGASLGLNVKVDYSSTSTESNAVTWNFNQPGYYGAYKGTKKVTGTYGSLNCNRVQQGDGSWALKWIEGSGDGSFTTYTTLEEGAVRCQDKVPAGSIMAKAQDLLDCGSAAAKAEHPAGAVAPTAKQKRDSLAQRQALTNGTSPQLPKATGHSTRAALDCQASAYKIAVPGKPLSWGAPLLADDGVRLRPSTIFSAHLDNWRLCNVTENNGVLEASLWNWGNGGCATIAAQNAATERAVLQTAPCTEDDLQRFYIYRDVPGSSKIGVQNKYTGSMMGHDRYADGEFIRQYSGGRQDGTGTYTLIGV

SEQ ID NO: 406 - protein, 1577 aa, Streptomyces Sp.
MPRHKALLIGASEYDDETIRSLPFVRDDLQRLEGALSDRGFRPVEIAESQRGITPNAVNRHVLRFLREAGRGDTLFIMLSGHGVHFDGRDYLVPEDAYYESEPFAESCVEIGWQKELEDSPAGQVVFLIDACREGSARRTKSPTRMPGWERPKIAATLRRKVAYVYACSKAQYALYVDESEAVLPQHADAAGTQPKDSFSLFSRAVADVVSQVPHTLHMGEFLDEVQRRVTALHTAYGKTPPVQRIRAETDIPWQEFTVLPGPARDAAEHPWVRSTATHPVWERTAPGPAREALKDVCATLAARLAEGYDTAAATLRDDPWHDAELAKRAQDRLGFLTGRLAAGTELSPTEGALTVLLPLIGQAFWTHEAAQRAAVVTAGPADQSTPERDRFGKFAQGFPRLQRRLRTLEQRGVADGSAERIRWWLFHRWLIRQPELYASQTLKTLLGPPPGGPECPEWVTDALSGERFMRFLQELRAAPFAVPRHTAGRTGEPDRSDRTDQRDSDYDVIAASTRDEHEVRESLVASLAKAAQAFAVDPVDLPEILVEHIGISDSVNLGDLLTTIRGSDWRTSGLGRSLNAVCEHPAVQIALREHAHRVDGLLRDINRTSALAPLRSLPPYADADRVRLSGNTPTHLADGIRFQLAEDRVQELLMGEELYGERELAIRELYQNALDAVRYRDRRTEYLRRTDGTPPEWDGLIEFVQKADTLGRPYLECRDNGVGMGLDELRNVFSQGGARFVDLPEYIEEQTAWAELGEPRIELHPNSRFGIGVLSYFMLADEIEVTTCRMGRDGRPGNKYVVKIAGPGNLFRVDDLGPGTDSGTTVRLLLTDHKERVSCVDTLQRVLWLAPYRTRAEHGSRRHEWEPGQLSVSGPELSWMDDSEMFLRSGACYPSEDPDVWWVDGTGRFLADGLLAATNTLTSTSTGESYGTVVNLREQHQPELSVDRKTIRSNDGSHVSALLSGALPSLFSTALPLLTPDWLVEVGLSSIRFADEVAERARTSGVSWPVGDTERPFDALGFFRPDQMLLPLVSGQYPAAPETHGMSYLRTIPAPVLRWRLLTLYQAGLGDALTDAALSSPALPCARPSDHLLLAADGLYTTLNWARRYKEWLAGPDNTQNFVSASRFVLDSGMLSAYEMTKWRDPEQVVTLDDTFQLVQQAELTAGDVAERLTALGYQVVPPTGSEEVGPEDLALLRPLGRADDSWLEPGSELSVAQLCFSAALAERSTREAADRLRELGFTVPSEYPNSDAWTAEDREVLQRLWALHADPVPADRAQEITYAQLISVARASGATTQAVVDLLRDTGFSVPSYDTPEQTFHDDEWALLVYNDIPLNVDRQVPLPHAVGVAHRTGQTLEEVAVRLRALGFEMPELPADGASLSKQDVNFLYARYERSSSRAWPEPDRPLGLSAIAERASRSTLSMTETAARLSSLGYHCAPDQSLLARLQEHDLDALRWTLPDEDDQTVISPTQLYSVAEHLGRHPEEVAQSLTDFGYNVAEIPDTWHQERKAEADLIDALSRGEEPIVDIRYEVEISLPTLATVAMRLRLPFRTVALKATALGMRHEAETWFAAG

SEQ ID NO: 407 - protein, 457 aa, Streptomyces Sp.
MRALPAPPRRIALLALSALLLLVPALWPRLTQPAAADTGSFSLLYDPGPAHDCYSLVVEDPPDKNTTPDPGRTSSAGCGAFAGTEEFTRKSPERPTWDIGTYGWNTSNWGTSPGYSFTTQTAAKTVTMQNDASGVCGLHETNVSYTYPDSQLKPGPDRAYRTAADGRINVSYRAKIQQTKPFACGEKRALLTTDLIFEDSEHGSAHPDVISVIHYDPGTFKAPDSNGVVWYTRDDTTMTCPDGCRVMVRSPDLMKDATWASIDDDFSQLFDKYVDYVNPEHLPKSDFVLRGVQIVSSNTGSSTTASVSDVDARMTPNAPVHAPLTYGLKGSDGQSLCLDDYDNATKPPAVADIWDCNGGDAQDWTIGQDDTLQVHGLCLGASGDGAADHTPVGLDPCDGGAHQKWVLGRYGQIYNPVSGRCLEVANGSSTRGDKNLELFDCWGGTQQKWWTPAGDYR

SEQ ID NO: 408 - protein, 457 aa, Streptomyces Sp.
MRALPAPPRRIALLALSALLLLVPALWPRLTQPAAADTGSSSLLYDPGPAHDCYALVVEDPPDKNTTPDPGRTSSAGCGAFAGTEEFTRKSPERPTWDIGTYGWNTSNWGTSPGYSFTTRTAAKTVTMQNDASGVCGLHETNVSYTYPDSQLKPGPDRAYRTAADGRINVSYRAKIQQTKPFTCGEKRALLTTDLIFEDSEHGSAHPDVISVVHYDPGTFKAPDSNGVVWYTRDDTTMTCPDGCRVMVRAPDLMKDATWASIDDDFSQLFDKYVDYVNPEHLPKSAFVLRGVQIVSSNTGSSTTASVSDVDARLTPNAPVHAPLTYGLKGSDGQSLCLDDYNNATKPPAVADIWDCNGGDAQDWTIGQDDTLQIHGLCLGASGDGTADHTPVGLDPCDGGAHQKWVLGRYGQIYNPVSGRCLEVANGSSTRGDKNLELFDCWGGTQQKWWTPAGDYR

SEQ ID NO: 409 - protein, 457 aa, Streptomyces Sp.
MRALPARPRRIALLALSALLLLVPALWPRLTQPAAADTGSVSLLYDPGPAHDCYGLVVEDPPDKNTTPDPGRTSSAGCGAFAGNEEFTRKSPERPTWDIGTYGWNTSNWGTSPGYSFTTQTAAKTVTMQNDASGVCGLHETNVSYTYPDSQLKPGPDRAYRTAADGRINVSYRAKIQQTKPFTCDEKRALLTTDLIFEDSEHGSAHPDVISVIHYDPGTFKAPGSNGVVWYTRDDTTMTCPDGCRVMVRAPDLMKDATWASIDDDFSQLFDKYVDYVNPEHLPKSDFVLRGVQIVSSNTGSSTTASVSDVDARMTPNAPVHAPLTYGLKGSDGQSLCLDDYNNATKPPAVADIWDCNGGDAQDWTIGQDATLQVHGMCLGVSGDRTADHTPVGLDPCDEGAHQKWVLGRYGQIYNPVSGRCLEVANGSSTRGDKNLELFDCWGGTQQKWWTPAGDYR

SEQ ID NO: 410 - protein, 457 aa, Streptomyces Sp.
MRALPARPRRIALLALSALLLLVPALWPRLTQPAAADTGSVSLLYDPGPAHDCYGLVVEDPPDKNTTPDPGRTSSAGCGAFAGTEEFTRKSPERPTWDIGTYGWNTSNWGTSPGYSFTTQTAAKTVTMQNDASGVCGLHETNVSYTYPDSQLRPGPDRAYRTAADGRIDVSYRAKIQQTKPFTCDEKRALLTTDLIFEDSAHGSAHPDVISVIHYDPGTFKAPDSNGVVWYTRNDTAMTCPDGCRVMVRAPDLMKDATWASIDDDFSQLFDKYVDYVNPEHLPKSDFVLRGVQIVSSNTGSSTTTSVSDVDARMTPNAPVHAPLTYGLKGSDGQSLCLDDYNNATKPPAVADIWDCNGGDAQDWTIGQDDTLQVHGLCLGASGDRTADHTPVGLDPCDEGAHQKWVLGRYGQIYNPVSGRCLEVANGSSTRGDKNLELFDCWGGTQQKWWTPAGDYR

SEQ ID NO: 411 - protein, 1445 aa, Streptomyces Sp.
MGGRTHLHRRRRRTAPHQLAVMAVLGALVFGAAPTATADSGDPTPGNPTQSALLQAQASGKSVPIDSLTSQTSTTTANPDGSLTTTEYVQPVRVMKNDAWTPVDASLVRNSDGSFSTAATPNGVTLSGGGSAPLVSLTDPAGHNLSLSVPFTLPAPTVSGDTALYSSVLPGVDLQATVSDQGGFSDVLIVHDATAAANPDLRRLTLAATTQGLSLAGSADGGMTAKAADGTTAYTSSAPVMWDSTTTTAGPQTASMRLDDATSTASPADGPAPGADVAPVTMTTTSSGLTLTPDSSMLTGTGTTWPVYIDPAVAPSETTNHYFEAQQGCNSSSASSHEYDYPQRFGEGVGYQRYASSNGDCIGAERAFYELDTSNLNSSMDIIKADLHLTETYAEAYGCTHTAPLTLKWTGRITNGMYWDTQPSVVSTIGTQNPKSAYNGAYVSQPTSCGDQGVTFTVTDKIASVAAANDATWTVGLYGDEDSSSSDIDFMRYSTNPYIQTTYDIPPDTPTGEATAPDAQNPSGANCGSSTRGWIGQTTLNGNTSDITLNAKLKSNVSGENVKADYTVWDDQTANSSGNAATVATPSSGYVASLTTVNVNIGTTVQDGHQYGWQVRAYDGINYSAWNSPCGFKVDLTPPSQPSVTAPSAVFPPSGSGKAPTGYAGQTSSITVTSSDPTPTGCTRGTCLSSDVWRFCYALDAQPAVNCPDYVTATANSSGTPSASIPLDPTTWGTHTLYVEAEDHAGNTQALPTTYTFYAPWNPATKVTAGDLNGDGVPDLLGTTKSGDLTLLPGNTDPGNSPTVASTAAQSPDGKSGWNDYLVTHRGSLKQDGLDDLFAYDKNSHDLYVYKNDGAVSGGTAGHFTNTADVYGPLARPQCLPTADNTANCTTYNTADWSSVTQMIAPGDVYGTGYPDLVTIENKQLWLYKGSAQDSSYLGPATGGTTSTTPVLLGTGDWSHFTLIAPGTVNTTPTLWARDNNTGTLYSFPLTADSNGQPPLLTAPSSFALTSGLTATDGSGLCADDSHSATQNGNKIQIWGCNNTLAQSWTPAADGSIRVMGKCLDVTHSGTTDGTPIDLWTCNGTGAQQWTPGSNNSLVNPESGKCLDDPNSSTTPGTQLQLHACNGTSAQSWTSSAPSTWNSNRATALPVTLATSDYPTIASPGNLNGTTPGYPALYTTTPSGELIEYPGAAPDSNGVATFGSPVTVGYYNTASAAWPLNDGSGTTAADSIGTNNATLNGPATWATDPSRGTVLSLDGTTGYAASTTSALQTGTHTDPADGTTTDNNSFSVSAWVKLNSLTGNSTLVSQSDSAGNANGFQLYYSSGSQVWAFGRHNDDTTSTAFTAAYGSKATTGAWTHLVGVYDGPTNTLNLYVNGTLTATKTFAGTPWNATGPVQIGRRLYQGTYGEYANATVSNVQLYNTALPPSEVSALDYDQTPYTQLS

SEQ ID NO: 412 - protein, 686 aa, Streptomyces Sp.
MPPPTVRRSRRRLPVALLAAALGAVTLGAPSPASASDTAEETGHLVGRGIADVTGEAAETGMMGYSSFDQKTSGIHQRQRSRAFVVVDRSTGKRVVYVNADLAMIFQSVRQGVMAQLKERYGSLYGEENVLLSATHTHSGPGGYSHNVAYNLSVLGFQKETYRAIVDGITESVAEAHEDLKPGTMSLGTGTLTNASVNRSREAFDRNPAADRAAFPDGIDPAMTVLRFKQGEKDAGAISWFATHNTSITNKNTLISPDNKGYASYAWEHDHEGVRYLDDTPGFVAAFPNTNAGDMSPNLNLKPGSGPTEDEFENTRIIGERQLDKAREIYDDARPVAGGVDSRLTYVDMESVTVRPEYTPDGKEHRTCPAVVGASTLAGSVEDGPAIPLFEEGMRTPIAPILEALRVDTPSWLATCQYPKASLIPTGLLSNVHPVTPKRLPLQIMKIGELHLVAAPGEFTIASGLRVRRTVAEQLGVPLDRVLLQGYANAYSQYVTTPEEYDTQNYEGGSTLYGRYTLPAYQQEYARVAESLRAGTALERGTMPADESGRQFTFQTGVVYDNPPSGKAFGGVLKAPESSYARGSTATVEFATGHPKNNVRRGSTFLEVQRLENGTWKRVLDDGDWETTYRWTRLNGLTGTSKATIIWKIAADTAPGTYRIVHHGDAKNLFGKITPFTGATGTFTVE

SEQ ID NO: 413 - protein, 686 aa, Streptomyces Sp.
MPPPAVRSSRRRLPVALLAAALGAVTLGAPSPASASDTAEDTGYLVGRGIADVTGEAAETGMMGYSSFDQKTSGIHQRQRSRAFVVVDKASGKRAVYVNADLAMIFQSVRQGVMARLTERYGSLYGEDNVLLSATHTHSGPGGYSHNVAYNLSVLGFQKETYRAIVDGITESVAEAHEDLKPGTMSLGTGTLTNASANRSREAFDRNPAADRAAFPDGIDPAMTVLRFKQGDKDAGAISWFATHNTSITNKNTLISPDNKGYASYAWEHDHEGVRYLDDTPGFVAAFPNTNAGDMSPNLNLKPGSGPTEDEFENARIIGERQLDKAREIYDDARPVAGGVDSRLAYVDMENVTVRPEYTPDGEEHRTCPAVVGASTLAGSVEDGPAIPLFEEGMRTPIAPILEALRVDTPSWLATCQYPKASLIPTGLLSNVHPVTPKRLPLQIMKIGELHLVAAPGEFTIASGLRVRRTVAEQLGVPLDRVLLQGYANAYSQYVTTPEEYDAQNYEGGSTLYGRYTLPAYQQEYARIAQSLRAGTALDRGTVPADESGRQFTFQTGVVYDNPPSGKAFGAVLKAPEGSYARGSTATVEFATGHPKNNVRRGSTFLEVQRLENGTWKRVLDDGDWETTYRWTRLNGLTGTSKATVTWKIAADTAPGTYRIVHHGDAKNLLGKITPFTGATGTFTVG

SEQ ID NO: 414 - protein, 686 aa, Streptomyces Sp.
MPPPTVRRSRRRLPVALLAAALGAVTLGAPSPASASGAAEDTGYLVGRGIADVTGEAAETGMMGYSSFDQKTSGIHQRQRSRAFVVVDRASGKRVVYVNADLAMIFQSVRQGVMAQLKERYGSLYGEDNVLLSATHTHSGPGGYSHNVAYNLSVLGFQKETYRAIVDGITESVAEAHEDLKPGTMSLGTGTLTNASVNRSREAFDRNPAADRAAFPDGIDPAMTVLRFKQGDKDAGAINWFATHNTSITNKNTLISPDNKGYASYAWEHDHEGVRYLDDTPGFVAAFPNTNAGDMSPNLNLKPGSGPTEDEFENARIIGERQLDKAREIYEDARPVAGGVDSRLAYVDMENVTVRPEYTPDGKEHRTCPAVVGASTLAGSVEDGPAIPLFEEGMRTPIAPILEALRIDTPSWLQSCQYPKASLIPTGLLSNVHPVTPKRLPLQIMKIGELHLVAAPGEFTIASGLRVRRTVAERLGVPLDRVLLQGYANAYSQYATTPEEYDTQNYEGGSTLYGRYTLPAYQQEYARIAESLREGTALDRGTSPADESARQFTFQTGVVYDNPPSGKAFGGVLKAPENSYARGSTATVEFATGHPKNNVRRGSTFLEVQRLENGTWKRVLDDGDWETTYRWTRLNGLTGTSKATITWKIAADTAPGTYRIVHHGDAKNLFGKITPFTGATGTFTVE

SEQ ID NO: 415 - protein, 686 aa, Streptomyces Sp.
MPPPTTRRSRRRLPVAVLAAALGAVTLGAPSPATASGAADDGGYLVGRGIADVTGEAAETGMMGYSSFDQKTSGIHQRQRSRAFVVVDRSSGKRVVYVNADLAMIFQSVQQGVIARLKERYGSLYDEENVLLSATHTHSGPGGHSHHVAYNLSVLGFQKETYRAIVDGITDSVAKAHEDLKPGTMSLGTGTLTNASVNRSREAFDRNPAADRAAFPDAIDPAMTVLRFKQGDKDAGAISWFATHNTSITNKNTLISPDNKGYAAYAWEHDHEGVRYLDDTPGFVAAFPNTNAGDMSPNLNLKPGSGPTEDEFENTRIIGERQLDKAREIYDRARPVAGGVDSKLAYVDMENVTVRPEYTPDGKEHRTCPAVVGASTLAGSVEDGPAIPGFEEGTRTPVAGIIDALRIDTPSWLQTCQYPKASLIPTGLLSNVHPVTPKILPLQIMKIGELHLVAAPGEFTITSGLRVRRTVAERLGVPLDRVLLQGYANAYSQYVTTPEEYDTQNYEGGSTLYGRYTLPAYQQEYDRIATSLRDGTDPERGTAPPDESARQFTFQTGVVYDNPPSGQAFGGVLKAPEASYARGSTATVEFATGHPKNNVRRGSTFLEVQRLENGSWQRVLDDGDWETTYRWTRLNGLTGTSKATITWDIAADTAPGSYRIVHHGDAKNLLGRITPFTGTTGTFTVR

SEQ ID NO: 416 - protein, 686 aa, Streptomyces Sp.
MPPPTTRRSRRRLPVAVLAAALGAVTLGAPSPASASHTADDGDYLVGRGIADVTGEAAETGMMGYSSFDQRTSGIHQRQRSRAFVVVDRSSGKRVVYVNADLAMIFQSVQQGVIARLKERHGSLYDEENVLLSATHTHSGPGGHSHNVAYNLSVLGFQKETYRAIVDGIAESVAEAHEDLKPGTMSLGTGALTNASVNRSREAFDRNPASDRAAFPGAIDPAMTVLRFKQGDEDAGAISWFATHNTSITNKNTLISPDNKGYAAHAWEHDHEGVRHLDDTPGFVAAFPNTNAGDMSPNLNLKPGSGPTEDEFENTRIIGERQLDKAREIYDDARPVAGGVDSRLAYVDMENVTVRPEYTPDGKEHRTCPAVVGASTLAGSVEDGPAIPGFEEGTRTPVAGIIDALRIDTPSWLQTCQYPKASLIPTGLLSNVHPVTPKRLPLQIMKIGELHLVAAPGEFTITSGLRVRRTVAEQLGVPLDRVLLQGYANAYSQYVTTPEEYDTQNYEGGSTLYGRYTLPAYQQEYARIAESLREGTDLERGTAPPDESGRQFTFQTGVVYDNPPAGKAFGAVLKAPEAWYARGSTATVEFATGHPKNNVRRGSTFLEVQRLENGSWTRVLDDGDWETTYRWTRLNGLTGTSKATVTWDIAADTAPGTYRIVHHGDTKSVLGKITPFTGATGTFTVN

SEQ ID NO: 417 - protein, 668 aa, Streptomyces Sp.
AAALGAATLGAPSPASASNTADGGDYLVGRGISDVTGEAAETGMMGYSSFDQKTSGIHQRQRSRAFVVVDRASGKRVVYVNADLAMIFQSVRQGVMARLKERYGSLYGEENVLLSATHTHSGPGGYSHNVAYNLSVLGFQKETYRAIVDGITESVAKAHEDLKPGTMSLGTGTLTNASVNRSREAFDRNPAADRAAFPDAIDPAMTVLRFKQGERDAGAISWFATHNTSITNKNTLISPDNKGYAAYAWEHDHEGVRYLDDTPGFVAAFPNTNAGDMSPNLNLKPGSGPTEDEFENARVIGERQLDKAREIYDGTRPVSGGVDSRLAYVDMENVTVRPEYAPDGKEHRTCPAVVGASTLAGSVEDGPAIPLFEEGMRTPIAPILEALRVDTPSWLATCQYPKASLVPTGLLSNVHPVTPKRLPLQIMKIGELHLVAAPGEFTIASGLRVRRTVARQLGVPLDRVLLQGYANAYSQYVTTPEEYDTQNYEGGSTLYGRYTLPAYQQEYDRIAKSLREGTTLDRGTMPADESGRQFTFQTGVVYDNPPSGKAFGGVLKAPEPSYARGSTATVEFATGHPKNNLRRGSTFLEVQRLVNGSWQRVLDDGDWGTTYRWTRLNDLTGTSKATITWDIAADTDPGTYRIVHHGDAKSLLGKITSFTGTTGGFTVR

SEQ ID NO: 418 - protein, 686 aa, Streptomyces Sp.
MPPPPSRSPRKLSALVLAAALGAAALGAPSSASAAPAADDGEYLVGRGIADVTGEAAETGMMGYSSFDQKTSGIHQRQRSRAYVVVDRATGKRVVYVNADLAMIFQSVQQGVIARLKERYGSLYGDENVLLSATHTHSGPGGYSHHVAYNLSVLGFQSATYRAIVDGIADSVAKAHDDLKPGTISLGTGTLTNASVNRSREAFDRNPAADRAAFPDGIDPAMTVLRFRQGERDAGAISWFATHNTSITNKNTLISPDNKGYASYAWEHDHEGVRYLDNTPGFVAAFPNTNAGDMSPNLNLKPGSGPTEDEFENTRIIGERQLDKAREVYAGARPVTGGVDSRLTYVDMENVTVRGEYTTDGKEQRTCPAVVGASTLAGSVEDGPAIPGFEEGARTPVASIIDALRIDTPSWLATCQYPKASLIPTGLLSNVHPVTPKILPLQIMKIGELYLVAGPGEFTITAGLRVRRTVAQELGVPLERVLLQGYANAYSQYVTTPEEYETQNYEGGSTLYGRNTLPAYQQEYARVAASLRQGTAIGRGTAPPDESARQFTFQTGVVYDNPPLGKSFGAVLTAPASSYARGSTATVEFATGHPKNNVRRGSTFLEVQRLEGGSWVRVLDDGDWETTYRWTRINGLTGTSKATVTWAIGADTAPGTYRIVHHGDAKNLLGKITPFTGASPTFTVSG

SEQ ID NO: 419 - protein, 685 aa, Streptomyces Sp.
MPPRPSRSPRKLSALVLATALGAVALGAPSPASAAPAAEPDYLIGRGIADVTGEAAETGMMGYSSFDQKTSGIHQRQRSRAYVVADRATGKRVVYVNADLAMIFQSVRQGVLARLEEKYGSLYGEENVLLSATHTHSGPGGYSHHVAYNLSVLGFQNGTYRAIVDGIAESVAKAHDDLKPGTISLGTGTLTNASVNRSRAAFDRNPAADRAAFPDGIDPAMTVLRFRQGDKDAGAISWFATHNTSITNKNTLISPDNKGYAAYAWEHDHEGVRYLDNTPGFVAAFPNTNAGDMSPNLNLRPGSGPTEDEFENTRVIGERQLDKAREVYRDAKPVTGRIDSRLTYVDMENVTVRGQYTSDGKEARTCPAVVGASTLAGSVEDGPAIPGFEEGMRTPVASIIDALRIDTPSWLATCQYPKASLVPTGLLSNVHPVTPKILPLQIMRIGELYLVAGPGEFTITAGLRVRRTVAQELGVPLERVLLQGYANAYSQYVTTPEEYDTQNYEGGSTLYGRNTLPAYQQEYAKVAASLRQGTPIGRGTAPPDESARQFTFQTGVVYDNPPLGKSFGSVLTAPASSYARGSTATVEFATGHPKNNVRRGGTFLEVQRLEAGKWVRVLDDGDWETTYRWTRINGLTGTSKATVTWDIGPDTAPGTYRIVHHGDAKNLLGKITPFTGTSPTFTVTG

SEQ ID NO: 420 - protein, 693 aa, Streptomyces Sp.
MSPPTPRRSRGRLAVLALVAALGAASFTAPPPALASSDTNSADATAADADYLVGRGIADVTGEAAETGMMGYSNFDQKTSGIHQRQRSRAFVVADRTSGKRVVYVNADLAMVFQSVRQGVLAGLKERYGSLYGEENVLLSATHTHSGPGGYSHDVAYNLSVLGFQSATYRAVVNGIVESVGKAHEDLKPGTISLGTGTLTNASVNRSRTAFDRNPAADRAAFPGGIDPAMTVLRFRQGDKDAGAISWFATHNTSITNKNTLISPDNKGYASYAWEHGLEGVRYLDNTPGFVAAFPNTNAGDMSPNLNLKPGSGPTEDEFENARILGERQLDKARAIFRDAKPVGGGVDSRLAYVDMESVTVNGAYTPDGKEHRTCPAVVGASTLAGSVEDGPAIPGFEEGMRTPVASIIEALQIDTPDWLAACQYPKASLVPTGLLSNVHPVTPKILPLQIMRIGELYLVAGPGEFTITSGLRVRRTVAEQLGVPLDRVLLQGYANSYSQYVTTPEEYDSQQYEGGSTLYGRYTLPAYQQEYARVAKSLREGSALDRGTAPPDESGRQFNFQTGVVYDNPPPGSTFGGVLTPPDASYARGRTATVEFATGHPKNNLRRGGTFLEVQRLVDGAWTRVLDDGDWSTKYRWTRINGLTGTSKATVTWDIAADTAPGTYRVVHHGDSKNLLGKITPFTGTSPTFTVS

SEQ ID NO: 421 - protein, 806 aa, Bacillus Sp.
MVHFKNCPDPSLNANSQSHPEFSSELEHIKTRMQNFIKHSVTDQNIEVTDARVTAEGEVTSLLKERLDKEYYRLLSKITREVNVADFGAVPDGRDNTEAFRKAIGNGRVKVHVPAGEYLVQGIKLPSWTTIVGQGKGITVIKLHEDTPAHEWVITNDDYQNGNRNIFVQGMSLDWNPSRQCGVRNPGGQFSSCLTFAKVEYGWIKDVEAINAGLHGIDITSPTYDHLPDTDWTKDGSRYIWIDNCVTYGSGDDGITTHYSEYIFISNCHSGNPRGTEFAEGVSNSNGIEIDDGSRHVWLLNNFTSGNIRGVEVKAHELWPASQNVHIIGHISYRDVRAFDLRHIGHHQITDPESTTAYDVTLIDCSAVEPVFNSLYDAVTPRALVISAYKNVNVSGFTAIGDPDYDYKENPVVALQYRSQNITINGIKIRGFKKAGVDINLSGGSNKTDYIKISNFDIYKSAPKGISIGGGLYNVNILNGTMITDNGTVAIQSPNNQATILGVQSEGYSVAASIKGQTYQQVPINLKGGIQLATTSGFAVNQTSAVIAGTGDITARGERNAVISSSGGSSTEGSRALIASSNNAHIRGNQASRTILSSENIILEEPYTVAGGHQSIKWLLDSVRGNGTFAGAISSSLGGYGEYFESSTGQLIHTGTIVTLRGEKIVPANVGDYMLGVISETSAFISGASSFVWQGRYLTNEFGGFIYETVTDEESGELIRVPKQNPDYDTALEANYHSRAARDEWHVVGLVGQHYVRIDETVNQGDYLTAHNGIGTKATEGSWKVMKITSAYTSEKGYGIALTVIK

SEQ ID NO: 422 - protein, 806 aa, Bacillus Sp.
MVHFKNCPDPSLNANSQSHPEFSSELEHIKTRMQNFIKHSVTAQNIEVTDARVTAEGEVTSLLKERLDKEYYRLLSKITREVNVADFGAVPDGRDNTEAFRKAIGNGRVKVHVPAGEYLVQGIKLPSWTTIVGQGKGITVIKLHEDTPAHEWVITNDDYQNGNRNIFVQGMSLDWNPSRQCGVRNPGGQFSSCLTFAKVEYGWIKDVEAINAGLHGIDITSPTYDHLPDTDWTKDGSRYIWIDNCVTYGSGDDGITTHYSEYIFISNCHSGNPRGTEFAEGVSNSNGIEIDDGSRHVWLLNNFTSGNIRGVEVKAHELWPASQNVHIIGHISYRDVRAFDLRHIGHHQITDPESTTAYDVTLIDCSAVEPVFNSLYDAVTPRALVISAYKNVNVSGFTAIGDPDYDYKENPVVALQYRSQNITINGIKIRGFKKAGVDINLSGGSNKTDYIKISNFDIYNSAPKGISIGGGLYNVNILNGTMITDNGTVAIQSPNNQATILGVQSEGYSVAASIKGQTYQQVPINLKGGIQLATTSGFAVNQTSAVIAGTGDITARGERNAVISSSGGSSTEGSRALIASSNNAHIRGNQASRTILSSENIILEEPYTVAGGHQSIKWLLDSVRGNGTFAGAISSSLGGYGEYFESSTGQLIHTGTIVTLRGEKIVPANVGDYMLGVISENSAFISGASSFVWQGRYLTNEFGGFIYETVTDEESGELIRVPKQNPDYDTALEANYYSRAARDEWHVVGLVGQHYVRIDETVNQGDYLTAHNGIGTKAAEGSWKVMKITSAYKSEKGYGIALTVIK

SEQ ID NO: 423 - protein, 800 aa, Bacillus Sp.
MVHFKNCPDPSLNAKSHPELEHIKTRMQNFIKHSVTDQNIEVTDARVTAEGEITSLLKERLDKEYYKLLSKITREVNVEDFGAVPDGRDNTEAFRKAIGNGRVKVNVPAGEYHVQGIKLPSWTTIVGQGKGITVIKLHEDTPAHEWVITNDDYQNGNRNIFVQGMSLDWNPSRQCGVRNPGGQFSSCLTFAKVEYGWIKDVEAINAGLHGIDITSPTYDHLPNTDWTKDGSRYIWIDNCVTYGSGDDGITTHYSEYIFISNCHSGNPRGTEFAEGVSNSNGIEIDDGSRHVWLLNNFTSGNIRGVEVKAHELWPASQNVHIIGHVSYRDVRAFDLRHIGHHQITDPESTTAYDVTLIDCSAVEPVFNSLYDAVTPRALVISAYKNVNVSGFTAIGDPDYDYKGNPVVALQYRSQNITINGIKIRGFKKAGVDINLSGGSNKTDYIKISNFDIYKSAPKGISIGGGLYNVNILNGTMITDNGTVGIQSPNNQATILGVQSEGYGIAASIKGQAYQQVPINLKGGVQLATTSGFAVNQTSAVIAGTGDIMARGERNAVISSSGGSSTEGSRALIASSNNAHLKGNHASRTILSSENIILEEPYTVAGGHQSMKWLLDSVGGNGTFAGAISSSLGGYGEYFESSNGQLIHTGTIVTLRGEKIAPANVGDYMLGVISETSAFISGASSFVWQGRYLTNEFGGFIYETVTDKESGELIQVPKQNPDYDTALESNYHSRAARDEWHVVGLVGQHYVRIDETVSQGDYLTAHHGIGTKATEGSWKVMKITSVYTSEKGYGIALTVIK

SEQ ID NO: 424 - protein, 827 aa, Bacillus Sp.
MLTPYLKDKTALILKERGDFRMVHFKNCPDPSLNANSQSHPEFSSELEHIKTRMQNFIKHSVTAQNIEVTDARVTAEGEVTSLLKERLDKEYYRLLSKITREVNVADFGAVPDGRDNTEAFRKAIGNGRVKVHVPAGEYLVQGIKLPSWTTIVGQGKGITVIKLHEDTPAHEWVITNDDYQNGNRNIFVQGMSLDWNPSRQCGVRNPGGQFSSCLTFAKVEYGWIKDVEAINAGLHGIDITSPTYDHLPDTDWTKDGSRYIWIDNCVTYGSGDDGITTHYSEYIFISNCHSGNPRGTEFAEGVSNSNGIEIDDGSRHVWLLNNFTSGNIRGVEVKAHELWPASQNVHIIGHISYRDVRAFDLRHIGHHQITDPESTTAYDVTLIDCSAVEPVFNSLYDAVTPRALVISAYKNVNVSGFTAIGDPDYDYKENPVVALQYRSQNITINGIKIRGFKKAGVDINLSGGSNKTDYIKISNFDIYKSAPKGISIGGGLYNVNILNGTMITDNGTVAIQSPNNQATILGVQSEGYSVAASIKGQTYQQVPINLKGGIQLATTSGFAVNQTSAVIAGTGDITARGERNAVISSSGGSSTEGSRALIASSNNAHIRGNQASRTILSSENIILEEPYTVAGGHQSIKWLLDSVRGNGTFAGAISSSLGGYGEYFESSTGQLIHTGTIVTLRGEKIVPANVGDYMLGVISETSAFISGASSFVWQGRYLTNEFGGFIYETVTDEESGELIRVPKQNPDYDTALEANYHSRAARDEWHVVGLVGQHYVRIDETVNQGDYLTAHNGIGTKATEGSWKVMKITSAYTSEKGYGIALTVIK

SEQ ID NO: 425 - protein, 806 aa, Bacillus Sp.
MVHFKDCPDPSLNANSQSHPKFSSELETIKTRMQNFIKHSVTDQNIEVTDARMTAEGEITSLLKERLDKEYYKLLSKITREVNVADFGAVPDGRDNTEAFRKAIGNGRVKVNVPAGEYLVQGIKLPSWTTIEGQGIGITVIKLHEDTPAHEWVITNDDYQNGNRNIFVQGMSLDWNPNRQGGVRNPGGQFSSCLTFAKVEYGWIKNVEAINAGLHGIDITSPTYDHLPDTDWTKDGSRFIWIDNCVTYGSGDDGITTHYSEYIFISNCHSGNPRGTEFAEGVANSNGIEIDDGSRHVWLLNNFTSGNIRGVEVKAHELWPASQNVHIIGHVSYRDVRAFDLRHIGHHQITDPESTTAYDVTLTDCSAIEPVFNSLYDAVTPRALVISAYKNVYVNGFTAVGDPDYDYKGNPVIALQYRSQNITINGVKIRGFKKAGVDINLSGGANKTDYVKISNFDIYHSAPKGISIGGGLYNVNILNGTMLTDNGTVGIQSPNNQATILGVQSEGYSVAASIKGQTYQQIPINLKGGVQLATTSGFAFNQTSAVIAGTGDITARGERNAVISASGGSSTEGSRALIASSNNAHIKGNKVSRTILSSESIILEEPYTVAGGHRSIKWLLDSIGGNGTFAGAISSSLGGYGEYYESSTGQLIHTGTIVTLRGEKIAPAHAGDYMLGVISETAAFISGTSSFTWQSRYLTNEFGGLIYEVMTDEETGELIRVPKQNPDYDTALETDYHSRAARDEWHVVGLVGQHYVRIDETVGQGDYLTAHNGIGTKATKGSWKVIKITSAYSSEKGYGIALTVIK

SEQ ID NO: 426 - protein, 806 aa, Salinibacillus Sp.
MVHFKNYPDPSLNAKSESHPEYTSEIEHVKERMQNLIRHSVTDQNVEVTDARMTAEGEITSLLKERLDREYHKLLSKITREVNVEDFGAVPDGRDNTEAFRKAIGNGRVKVNVPAGEYLVQGIKLPSWTTIAGQGKGITVIKLHEDSPAHEWVITNDDYQNGNRNIFVQGMSLDWNPNRQCGVKNPGGQFSSCLTFAKVEYGWIRDVEAINAGLHGIDITSPTYDHLPDTDWTKDGSKYIWIDNCVAYGSGDDGITTHYSEYIFISNCHSGNPRGTEFAEGVSNSNGIEIDDGSKHVWLLNNFTSGNIRGVEVKAHAMWPASQNVHIIGHVSYRDVRAFDLRHIGHHQATDPESTTAYDVTLIDCSAIEPVFNSLYEAVTPRALVVSAYKNVNVSGFTAIGDPDYDYKENPVVALQYRSQNITLSGIKIRGFKKAGVDIHLSGGSNKTDYIKISNFDIYQSAPKGISIGGGLYNVNILNGTMIADNGAVGIQSPNNQTVILGVHAEGYSAAVTIKGQSYQHVPINLKGGAQLATTSGFAFNQTSAVIAGTGDITAKGERNAVIGASGGSSTEGSRALIASSNNAHIKGNNVSRTILSSESIILEEPYTVAGGHQSMKWLLDSVGGNGTFAGAISSSLNGYGEYFESSTGQLIQTGTIVTLRGEKIAPAHVGDYMLGVISETAAFISGASSFVWQDRYMTNEFGGFIYEDLIDKETGELIRVPKQNPDYDAALETAYHSRAVRDEWHVVGLAGQHYVRIDETVGQGDYLTAHNGIGTKASEGTWKVMKITTIYTPEKGYGIALTVIR

SEQ ID NO: 427 - protein, 806 aa, Bacillus Sp.
MVHYQNYPDPSLNAKLQSHPEHSSEIEHLKARMQNFIKHSVTEQNIEVTDARVTAEGEVTSLLKERLDKEYHKLLCKITREVNVEDFGAVPDGRDNTEAFRKAIGNGRVKVNVPAGEFLVQGIKLPSWTTIVGQGKGITVIKLHEDTPAHEWVITNDDYQNGNRNIFVQGMSLDWNPDRQCGVRNPGGQFSSCLTFAKVEYGWMKDVEAINAGLHVIDITSPTYDHSPDTDWTKDGSKYIWIDNCVAYGAGDDGITTHYSEYIFISNCHSGNPRGTEHAEGISNSNGIEIDDGSKHVWLLNNFTSGNIRGVEVKAHAMWPASQNVHIIGHVSYRDVRAFDLRHIGHHQATDPESTTAYDVTLIDCSAIEPVFNSLYEGVTPRALVVSAYKNVNVSGFTAIGDPDYDYGGNPVVAMQYRSQNIAINGIKIRGFKKAGVDINLSGGTNKTDYIKISNFDIYHSAPKGISIGGGLYNVNIMNGTMISDSGTVGIQSPNNQAVILGVQAEGYSAAVSIKGQTYQHVPVNLKGGAQLATTSGFAFNQTSAVIAGTGEITAKGERNAVIGASGGSSTEGSRALIAASNNAHIKGNNVSRTILSSESITLEEPYTVAGGHQSMKWLLDSVGGNGTFAGAISSSLRGYGEYFESSTGQLINTGTIVTLRGDKIAPAHVGDYMLGVISETAGLVSGASSFIWQGRYLTNEFGGLIYEDVTDEETGELIRMPKKNPDYDAALEADYLSRSARDEWHVVGLVGQHYVRIDETVSQGDYLTAHNGIGTRASEGDWKVMKITASYIPEKGYGIALDVIR

SEQ ID NO: 428 - protein, 806 aa, Bacillus Sp.
MVQFKNYPDPSLNAKMQSHPEHSSEFEHLKARMQNFIKHSVTDQNLEIADARVTAEGVVTSLLKERLDKEYDKLMSKITREVNVEDFGAVPDGRDNTEAFQKAIGNGRVKVNVPAGEFLVQGIKLPSWTTISGQGKGITTIKLHEDAPAYEWVITNDDYQNGNRNIFVQGMSLDWNPDRQCGVRNPGGQFSSCLTFAKVEYGWIKDVEVINAGLHGIDITSPTYDHLPDTDWTKDGCRYIWIDNCVAYGAGDDGITTHYSEYIFISNCHSGNPRGTEHAEGSANSNGIEVDDGSKHVWLLNNYTSGNIRGVEVKAHSLWPASQNVHIIGHVSYRDVRAYDIRHIGHHQASDPESTTAYDVTLTDCSAIEPVFNSLYESVTPRALVISAYKNVNISGFTAIGDPAYDYGGNPVVALQYRSQNITINGIKIRGFKQAGVDINLSGGSNKTDYVKISNFDIYQSSPKGISIGGGLYHVNIINGTMIGDGGSVGIQTPNSQAVILGVHAEGYSAAASIKGQTYEQIPVNLKGGAQLATSSGFAFDPTSAVIAGTGDIMAKGERNAIISASGGSSTEGSRALIAASNNAHITGSNVSRTILSSESITLEEPYTVAGGHQSIKWKLDSAGGNGTFAGAITSSLTGYGEYFESSTGQVIPAGTIVTVRGEKIEPAHVGDYMLGVISETAAFVSGASSFVWQGRYLTNEFGGFIYENVTDEETGETIRMPKQNPDYDPALEADYHSRALRDEWHVVGLVGRHYVRIDQTVSQGDYITAHNGIGTKAAEGDWKVMKITALYTPEKGYGIALAVIR

SEQ ID NO: 429 - protein, 806 aa, Bacillus Sp.
MVQFKNYPDPSLNAKMQSHPEHSSEFEHLKARMQNFIKHSVTDQNLEIADARVTAEGVVTSLLKERLDKEYDKLMSKITREVNVEDFGAVPDGRDNTEAFQKAIGNGRVKVNVPAGEFLVQGIKLPSWTTISGQGKGITTIKLHEDAPAYEWVITNDDYQNGNRNIFVQGMSLDWNPDRQCGVRNPGGQFSSCLTFAKVEYGWIKDVEVINAGLHGIDITSPTYDHLPDTDWTKDGCRYIWIDNCVAYGAGDDGITTHYSEYIFISNCYSGNPRGTEHAEGSANSNGIEVDDGSKHVWLLNNYTSGNIRGVEVKAHSLWPASQNVHIIGHVSYRDVRAYDIRHIGHHQASDPESTTAYDVTLTDCSAIEPVFNSLYESVTPRALVISAYKNVNISGFTAIGDPAYDYGGNPVVALQYRSQNITINGIKIRGFKQAGVDINLSGGSNKTDYVKISNFDIYQSSPKGISIGGGLYHVNIINGTMIGDGGSVGIQTPNSQAVILGVHAEGYSAAASIKGQTYEQIPVNLKGGAQLATSSGFAFDPTSAVIAGTGDIMAKGERNAIISASGGSSTEGSRALIAASNNAHITGSNVSRTILSSESITLEEPYTVAGGHQSIKWKLDSAGGNGTFAGAITSSLTGYGEYFESSTGQVIPAGTIVTVRGEKIEPAHVGDYMLGVISETAAFVSGASSFVWQGRYLTNEFGGFIYENVTDEETGETIRMPKQNPDYDPALEADYHSRALRDEWHVVGLVGRHYVRIDQTVSQGDYITAHNGIGTKAAEGDWKVMKITALYTPEKGYGIALAVIR

SEQ ID NO: 430 - protein, 838 aa, Bacillus Sp.
MIKNLKDKRKRRQAACFAFKSALISKERGVFRMVHYQNYPDPSLNAKLQSHPEHSSEIEHLKARMQNFIKHSITEQNIEVTDARVTAEGEVTSLLKERLDKEYHKLLCKITREVNVEDFGAVPDGRDNTEAFRKAIGNGRVKVNVPAGEFLVQGIKLPSWTTIVGQGKGITVIKLHEDTPAHEWVITNDDYQNGNRNIFVQGMSLDWNPDRQCGVRNPGGQFSSCLTFAKVEYGWIKDVEAINAGLHGIDITSPTYDHSPDTEWTKDGSKYIWIDNCVAYGAGDDGITTHYSEYIFISNCHSGNPRGTEHAEGISNSNGIEIDDGSKHVWLLNNFTSGNIRGVEVKAHALWPASQNVHIIGHVSYRDVRAFDLRHIGHHQATDPESTTAYDVTLIDCSAIEPVFNSLYEGVTPRALVVSAYKNVNVSEFTAIGDPDYDYGGNPVVAMQYRSQNIAINGIKIRGFKKAGVDINLSGGTNKTDYIKISNFDLYHSAPKGISIGGGLYNVNIMNGTMIADSGTVGIQSPNNQAVILGVQAEGYSAAVSIKGQTYQHVPVNLKGGAQLATTSGFAFNQTSAVIAGTGEITAKGERNAVIGASGGSSTEGSRALIAASNNAHIKGNNVSRTILSSESITLEEPYTVAGGHQSMKWLLDSVGGNGTFAGAISSSLRGYGEYFESSTGQLINTGTIVTLRGEKIAPAHVGDYMLGVISETAGLVSGASSFIWQGRYLTNEFGGLIYEDVTDEETGELIRMPKKNPDYDAALEADYLSRSARDEWHVVGLVGQHYVRIDETVSQGDYLTAHNGIGTRASEGDWKVMKITASYIPEKGYGIALAVIR

SEQ ID NO: 431 - protein, 805 aa, Bacillus Sp.
MVQFKNFPDPSLNAPLQSRPAQPSELEHLKARMQNFIKHSATDDNLEIADARVTAEGMVTSLLKERLDTEYEMLMNKITREVNVEDYGAVPDGRDNTEAFRRAIGNGRVKVNVPAGEFLVQGIKLPSWTTISGEGQGITVLKLHEDTPAFEWVITNDDYENGNRNIFVENMTLDWNPDRQCGVRNPGGQFSSCLTFANVQYGWIKNVETVNAGLHGIDITSPTYDHLPETEWTKDGCRYIWIDNCVAYGAGDDGITTHYSEYIFISNCHSGNPRGTEHAEGSANSNGIEIDDGSKHVWLLNNYTSGNIRGIEVKAHSLWPASQNVHIIGHVSYRDVRSFDIRHIGHHQASDPESTTAYDVTLTDCTAIEPVFNALYDGVTPRALVISAYKNVNVNGFTAIGDPSYDYGGNPVVALQYRSQNITINGIKIRGFTQAGVDINISGGSNKTDYVKILNFDIYKSSPKGISIGGGQYNVNIMNGTMIGDGGSVGITSPNSQAVILGVQAEGYSAAASIKGQTYEQIPVNLKGGAQLATSSGFAFNPTSAVIAGTGDITARGDRNAIISSSGGSSSEGSRAFIAASNNVHITGSKVSRTILSSESITLEEPYTVAGGHQSIKWKLDSAGGHGTFAGAVTSSLSGYGEYFESVTGQTIPAGTIVTVKGEKIESAHVGDYMLGVISETAAFISGAASFGWQSRFLTNEFGGFIYENVTDEETGETVRVPKQNPDCSPALEADYEARAARDEWHIVGLNGRHYVRVDSTVSPGDYITAHNGIGTKAAEGWKVLKLTALYSSEKGYGIAIAVIK

SEQ ID NO: 432 - protein, 805 aa, Streptococcus Sp.
MVQFKNFPDPSLNAPLQSRPAQPSELEHLKARMQNFIKHSATDDNLEIADARVTAEGMVTSLLKERLDTEYEMLMNKITREVNVEDYGAVPDGRDNTEAFRNAIGNGRVKVNVPAGEFLVQGIKLPSWTTISGEGQGITVLKLHEDTPAYEWVITNDDYENGNRNIFVQNVTLDWNPDRQCGVRNPGGQFSSCLTFANVQYGWIKNVETVNAGLHGIDITSPTYDHLPETEWTKDGCRYIWIDNCVAYGAGDDGITTHYSEYIFISNCHSGNPRGTEHAEGSANSNGIEIDDGSKHVWLLNNYTSGNIRGIEVKAHSLWPASQNVHIIGHVSYRDVRSFDIRHIGHHQASDPESTTAYDVTLTDCTAIEPVFNALYDGVTPRALVISAYKNVNVNGFTAIGDPSYDYGGNPVVALQYRSQNITMNGIKIRGFTQAGVDINISGGSNKTDYVKILNFDIYKSSPKGITIGGGQYNVNIMNGTMIGDGGSVGITSPNSQAVILGVQAEGYSAAASIKGQTYEQIPVNLKGGAQLATSSGFAFNPTSAVIAGTGDITARGDRNAIISSSGGSSSEGSRAFIAASNNVHITGGKVSRTILSSESITLEEPYTVAGGHQSIKWKLDSAGGHGTFAGAVTSSLSGYGEYFESVTGQTIPAGTIVTVKGEKIESAHVGDYMLGVISETAAFISGAASFGWQSRFLTNEFGGFIYENVTDEETGETVRVPKQNPDCSPALEADYEARAARDEWHIVGLNGRHYVRVDSTVSPGDYITAHNGIGTKAAEGWKVLKLTALYSAEKGYGIAIAVIK

SEQ ID NO: 433 - protein, 814 aa, Bacillus Sp.
MVHSQKPSDVSLNAELRSTAKGQFLKHQNRLTEIEQLKARMQNLIQHVETSQSVEVTDARVTAEGEAASLLKERLDKEYHKLLGKITREVNVADFGAVPDGRDNTEAFRNAIGNGRVKVNIPAGEYFVQGIKLPSWTYLVGQGKGVTVIKLHEDTPAHEWVITNDDYENGNRHIFVQGMTLDWNPDRQCGVRNPGGQFSSCLTFAKVEFGWIKDIEAVNAGLHGIDITSPTYDHLPDTDWTKDGSKYIWIDNCVAYGAGDDGITTHYSEYIFISNCYSAAPRGTEHAEGMANSNGIEIDDGSKHVWLLNNVTSGNIRGVEVKAHEMWPASQNVHIIGHISYRDVRAFDLRHIGHHQASDPESTTAYDVTLIDCTAVEPVFNSLYESVTPRALVVSAYKNVYISGFTAIGNPDYDYGGYPVVALQYRSQNITINGIKIRGFKKAGIDIRLLGGANQTDHIKISNFDFYHSAPIGISIGGGLYNVNIMNGTMITEGGTAGIQSPNSQAVIIGVLAEGYSAAASIKGQTYQQMPVNLKGGAQIATTSGFAFNQTSAVIAGTGDITAKGERNAVIGASGGSSTEGSRAFVTASNNSHITGNGVSRTILSSESITLEEPYTVAGGHQSIKWLLDSRYGNGAFAGAVTSSLTGYGEYFESESGQLIDTGTIVTLKGEKIAPAQSGNDLLGVVSETTAFVSGASSFVWQRRYLTNEFGGLIDEEVTDHETGELIRLPKQNPDYNESLEGSYLSRDVRDEWHVVGLLGRQYVRIDGTVRQGDYLGAIDGIGTKATEGSWKVIKITSPYTPEKGYGIALALIK

SEQ ID NO: 434 - protein, 266 aa, Kitasatospora Sp.
MINIRIRTAAGAVALACAVVLTPESLAAAAPAAQADAAPFSCLDPSGEALWSGPQCDGVIVHELGTEAVAIVLDGRRIDFADEAELRADDCADRPAVTLPASTFESIPEGPDPLYAAVDRRVDVPRITPTPHWRKNCHPLFRSDGRDPSVIFEQGFAPKDTVNGQYDITSYVLQNQPSPFVSTTYDPELYKKWKKVPWDYFIDAPGGIDVNATIGDQHQYADQVEVAFPGGVDRHFISRACPVDRATASLVESGCVDNPNYQPWLH

SEQ ID NO: 435 - protein, 1071 aa, Stenotrophomonas Sp.
MMHVATRNTLQSRLLLLPLLSLPMTLATAANTLETVQVTATLPVGGGGAGGFGFGGGSGVHLSESQMDNGGGGGAIPTETAKEQPTDDKEKDCNGRKGNPVVLYSGNKVEPELDFASQGEMGLFLQRNYNHYWSATGLFGNHWLSNFDYSLAFTDANQLAWVQRPDGRRIKYLKDPASGRWYEDKAQPIAYLAANGDGTFTLRNENNGTEIYNAEGYITRLSNEQGVSWTFSYTDHYLQKVTHSSGRSISFGWTNGQVSQVTDPAGNIYRYTYTPNVFGNGRGRLASTTLPSAPATTISYHYEDGRFPGALTGKSLDGVRYSTFAYDAERRAISTEHNGGIERFRFSYAVRSTEPVLPPPAPARPGGVRADEERGWCEQRPGGSRICYQPRSLPVDSLPMESALGMTAAAAPSLTRPVDIDVTVINPLGRSTTYTFKDGKIVSTKGDPSPNCPASYKEQSYDANGYPDLVHDFQDNLTNFDYSAQGYLLKRVEAVGSTAERTTLQEWDTARNRLLKTTVVGDLEVAYTYDDRGNVASVTERNLTARGVPSQTRVTRTTYSYHANGLKASIKIDGPLPQDDVTSTFNNQGDLTSTTNALGHTISYSNFNGLGLPGRIVNANGGVRELTYDGRGRVVSDRTSSGTGWATTAIGYTSAGDIASLTQPDGVTVRYGYDAGRRLTHEVRSLGDGTWAWTRHSYNNASNRTRTEVSQTDYPIDTAVKGMIDEITHDGQWNWFARGWACSTGSAGSIQVDGYAEGNVYLGSTQANLASEPGVAAACQASGNGYRYQLPISLAQRQQLGGRKFSIYGVSPKGAQHNQALGNSGNFAIPTATIIGDVAGVTNDANWNFSVQGWACSVGVNAATTVHIYAGGPAGAGTYLGSVTGTLVPNDDVKAACQSQGAYWFGFTLDSNMRNAHGGKPIYVHGISHSGQAHLLLNRSGTFTVPAVVRNAEVVGASAYPYQIFNGGSSTLIFEFRNTSNVVWNPGDTYLAFGLNQPNENIALSAPVPPGGVARFSRSVGPNNPGSGNRTFSYVARMASGGVAWGAEAKVFLSVENNKGSCGRITCERPR

SEQ ID NO: 436 - protein, 1073 aa, Stenotrophomonas Sp.
MMHFATRNILKSPLLLLPFLSLPMTPATAASTEGTVYVTKKRLPGTGGGGVGGFGFGGGSEIHLSEAQMDNGGGGGAIPTETAKEQPTDDKEKDCNGRKGNPVVLYSGNKVEPELDFASQGEMGLFLQRNYNHYWSATGLFGNHWLSNFDYSLAFTDANQLAWVQRPDGRRIKYLKDPASGRWYEDKAQPIAYLAANGDGTFTLRNENNGTEIYNAEGYITRLSNEQGVSWTFSYTDRYLQKVTHSSGRSISFGWTNGQVSQVTDPAGNIYRYTYTPNVFGNGRGRLASATLPGTPATTISYHYEDARFPGALTGKSFDGVRYSTFAYDAERRAISTEHNGGIERFRFSYAVRSTEPVLPPPAPARPGGVRADEERGWCEQRPGGSRICYQPRSLPVDSLPMESALGMTAAAAPSLTRPVDIDVTVINPLGRSTTYTFKDGKMVSTKGDPSPNCPASYKEQSYDANGYPDLVHDFQDNLTNFDYSAQGYLLKRVEAVGSTAERTTLQEWDTARNRLLKTTVVGDLEVAYTYDDRGNVASVTERNLTARGVPSQTRVTRTTYSYHANGLKASIKIDGPLPQDDVTSTFNNQGDLTSTTNALGHTISYSNFNGLGLPGRIVNANGGVRELTYDGRGRVVSDRTSSGTGWATTAIGYTSAGDIASLTQPDGVTVRYGYDAGRRLTHEVRSLGDGTWAWTRHSYNNASNRTRTEVSQTDYPIDTAVKGMIDEITHDGQWNWFARGWACSTGSAGSIQVDGYAEGNVYLGSTQANLASEPGVAAACQASGNGYRYQLPISLAQRQQLGGRKFSIYGVSPKGAQHNQALGNSGNFAIPTATIIGDVAGVTNDANWNFSVQGWACSVGVNAATTVHIYAGGPAGAGTYLGSVTGTLVPNDDVKAACQSQGAYWFGFTLDSNMRNAHGGKPIYVHGISPSGQAHLLLNRSGAFTIPAVVRNAELVSASASPRQIFNGGSSNLTFQFRNTGNVVWNPGDTYLAFGILQLNESMGLAGPVPPGAVATFSRSVGPKNTGNGNVTFIYKAQMASGGTAWGPEGRATLSVENNKGSCGRVTCERPR

SEQ ID NO: 437 - protein, 1005 aa, Stenotrophomonas Sp.
MDNGGGGGAIPTETAKEQPTDDKEKDCNGRKGNPVVLYSGNKVEPELDFASQGEMGLFLQRNYNHYWSATGLFGNHWLSNFDYSLAFTDANQLAWVQRPDGRRIKYLKDPASGRWYEDKAQPIAYLAANGDGTFTLRNENNGTEIYNAEGYITRLSNEQGVSWTFSYTDRYLQKVTHSSGRSISFGWTNGQVSQVTDPAGNIYRYTYTPNVFGNGRGRLASTTLPGAPATTISYHYEDGRFPGALTGKSFDGVRYSTFAYDAERRAISTEHNGGIERFRFSYAVRSTEPVLPPPAPARPGGVRADEERGWCEQRPGGSRICYQPRSLPVDSLPMESALGMTAAAAPSLTRPVDIDVTVINPLGRSTTYTFKDGKIVSTKGDPSPNCPASYKEQSYDANGYPDLVHDFQDNLTNFDYSAQGYLLKRVEAVGSTAERTTLQEWDTARNRLLKTTVVGDLEVAYTYDDRGNVASVTERNLTARGVPSQTRVTRTTYSYHANGLKASIKIDGPLPQDDVTSTFNNQGDLTSTTNALGHTISYSNFNGLGLPGRIVNANGGVRELTYDGRGRVVSDRTSSGTGWATTAIGYTSAGDIASLTQPDGVTVRYGYDAGRRLTHEVRSLGDGTWAWTRHSYNNASNRTRTEVSQTDYPIDTAVKGMIDEITHDGQWNWFARGWACSTGSAGSIQVDGYAEGNVYLGSTQANLASEPGVAAACQASGNGYRYQLPISLAQRQQLGGRKFSIYGVSPKGAQHNQALGNSGNFAIPTATIIGDVAGVTNDANWNFSVQGWACSVGVNAATTVHIYAGGPAGAGTYLGSVTGTLVPNDDVKAACQSQGAYWFGFTLDSNMRNAHGGKPIYVHGISPSGQAHLLLNRSGTFTVPAVVRNAEVVGASAYPYQIFNGGSSTLIFEFRNTSNVVWNLGDTYLAFGLNQPNENIALSAPVPPGGVARFSRSVGPNNPGSGNRTFSYVARMASGGVAWGAEAKVFLSVENNKGSCGRVVCERPR

SEQ ID NO: 438 - protein, 1074 aa, Stenotrophomonas Sp.
MMHFATRNTLKSRLLLLPLLSLPMTLATAANTLETVQVTAKRPAGGGGVGGFGFGGGSGVHLSESQMDNGGGGGAIPTETAKEQPTDDKEKDCNGRKGNPVVLYSGNKVEPELDFASQGEMGLFLQRNYNHYWSATGLFGNHWLSNFDYSLAFTDANQLAWVQRPDGRRIKYLKDPASGRWYEDKAQPIAYLSANGDGTFTLRNENNGTETYNVEGYITRLSNEQGVSWTFSYADRYLQKVTHSSGRSVSFGWANGQVSQVTDPAGNVYRYTYTPNVFGNGRGRLASSTLPGTPATTISYHYEDARFPGALTGKSFDGVRYSTFAYDAERRAISTEHNGGIERFRFSYAVRSTEPVLPPPAPTRPGGVRADEERGWCEQRTGGSRICYQPRSLPVDSLPMESALGMTAAAAPGLTRPVDIDVTVINPLGRSTTYTFKDGKMVSTKGDPSPNCPASYKEQSYDANGYPDLVHDFQDNLTNFDYSAQGYLLKRVEAVGSSAERTTLQEWDTTRNRLLKTTVVGDLEVAYSYDDRGNVASATERNLTARGVPSQTRVTRSTYTYHANGLKASIKVDGPLAQDDVTSVFNGQGDLTSVTNALGHTISYSNYNGLGLPGRIVNANGGVRELTYDGRGRVVSDRTSSGTGWATTAIGYTAAGDIASLTQPDGVTVRYGYDAGRRLTQEVRSMGDGKWAWIRHSYNNASNRTRTEVSQTDYPMDTVVKGMIDEITHDGQWNWFVRGWACSTGSAGSIQVDGYADGNVYLGSTQANLASEPGVAAACQASGSAYRYQLPISLAQRQQLGGRKFSIYGQSPQGRGQDRPLPNSGVLAIPTAKIVGDIGGVTQDGNWNFFLEGWACSIGVDSSIDVHVYAGSSAWAGGTFVASGRANLATDGNVASACQARGNAYWFKIPLDGNLRSAHGGKALYVHGISPWGGDHLTINRSGTFTVPAVVRSAEFVSFNAYPTNITNGRQSTLTIQVRNTGNVVWDGNTYLAWGQDQLDQSRALAGPVSPGGIASFSIDVAPYHDGIGIRSFAYIAQMATNGMAWGPRPYTMIAVENADWYCPPNSTTCEAPM

SEQ ID NO: 439 - protein, 1073 aa, Pseudomonas Sp.
MMHVATRNTLQSRLLLLPLLSLPMTLATAANTLETVQVTAKRPAGGSGVGGFGFGGGSGVHLSESQMDNGGGGGAIPTETAKEQPTDDKEKDCNGRKGNPVVLYSGNKVEPELDFASQGEMGLFLQRNYNHYWSATGLFGNHWLSNFDYSLAFTDANQLAWVQRPDGRRIKYLKDPASGRWYEDKAQPIAYLSANGDGTFTLRNENNGTETYNAEGYITRLSNEQGVSWTFSYADRYLQKVTHSSGRSVSFGWANGQVSQVTDPAGNIYRYTYTPNVFGNGRGRLASSTLPGTPATTISYHYEDARFPGALTGKSFNGVRYSTFAYDAERRAISTEHNGGIERFRFSYAVRSTEPVLPPPAPTRPGGVRADEERGWCEQRTGGSRICYQPRSLPIDSLPMESALGMTAAAAPSLTRPVDIDVTVTNPLGRSTTYTFKDGKMVSTKGDPSPNCPASYKEQSYDANGYPDLVHDFQDNLTNFDYSAQGYLLKRVEAVGSSAERTTLQEWDTTRNRLLKTTVVGDLEVAYSYDDRGNVASATERNLTARGVPSQTRVTRSTYTYHPNGLKASIKVDGPLAQDDVTSVFNSQGDLTSVTNALGHTISYSNYNGLGLPGRIVNANGGVRELTYDGRGRVVSDRTSSGTGWATTALGYTAAGDIASLTQPDGVTVRYGYDAGRRLTQEVRSMGDGKWAWTRHSYNNASNRTRTEVSQTDYPMDSMVSGVIDEITHDAQWNWFVRGWACSTGSAGSIQVDGYADGNVYLGSTQANLASEPGVAAACQASGSAYRYQLPISLAQRQQLGGRKFSVYGQSPQGRGQDRPLANSGVFAIPTANIVGDIGGVTQDGNWNFFIEGWACSVGVDASIDVHVYAGGAAGGGTFVASGRANLATDGNVANACQARGSAYWFKIPLDGNVRSNHGGKALYVHGISPVGGPNLTINRSGTFTVPAVVRSAEFVSFNAYPTNITNGRQSTLTIQVRNTGNVVWDGNTYLAWGQDQLDQSRALAGPVSPGGIASFSIDVAPYHDGIGIRSFAYIAQMATSGRAWGPRPYTMIAVENADWYCPPNSTTCEAPM

SEQ ID NO: 440 - protein, 740 aa, Streptomyces Sp.
MGHRSSELRRRRRRRLTRRSALVAAVVAAGLVAGTLGIRTALESTAVNSAVTAAEGAADHSGSQAGLVSDDGSGETGTAEGGTQAPAPKRDEKATPLKSIPKDQPERGLVYAGLSLPSSDRCGGTLEVTGSAQCSHGPDVPPKGVDIHQDVPPVAAPAGQAPTLTPPAGAQPPAASDLLKGAAPVLDATQKALLGGSGSAAADAAPAAPAAPAASKLVCEGDGSSGNRVQAVYVHTPGNDRFAQYLASFKKWAADVDVIYNASAAETGGERHVRFVTESDCTASVLNVQISDAEIQDFNASNRALAAQGFNRKDRKYMMFTDAKVYCGIGTFAGDERPGQDNLSNFGPSYGRTDSGCWSGSTAAHELGHNLGAVNNSAPNSSKAGHCTDEWDIMCYSDAPNYPQMRTVCPDRAHDDRLDCNHDDYYNTSPAPGSYLATHWNVANNRFLVSGGGTGPTPTPTPTPTPTPTRTPSPSPTPTGGPTTTPTPTATPSPTGTTTPTPTPTPTPTQGNTGPDMTVSQVTQNSAMLSWPAVPAAAGYDVLLNGQTIGTVRSTVVGVVRLAPGTSYTVAVAVRDAAGAVGKPGRAVTFRTVADAGRPQPGTRYTMVNGLTGQAADLWGSSMNDGTVAIAYQRTGYANQKWQFEDAGNGAVRIKSVRSGKCLQLGGTPVAGQYVAQQPCSDAAAQKWQLTAGDGGFTVTADGSSLVLGLSERWYYGGWLLELQQPNGRPYQSWSLLKTS

SEQ ID NO: 441 - protein, 750 aa, Streptomyces Sp.
MGHRSSELRRRRRRRLTRRSALVAAAVAVGLVAGTLGIRSALEPTAVHGAVTAAEGAADHSGSQAGLITDDGGPGETGTAEGGAQAPAPKRDEKAAPLKSIPKDQPERGLVYAGLSLPTSDRCGGTLEVTGSAQCSHGPDVPPKGVDIRQDVPPVAAPAAQAPALTPAAGAQPPAAADLLKGAAPVLDATQKALLGGSGSAAADTAPVAPSASAAPAGSKLVCEGDGSSGNRVQAVYVHTPGNDRFAQYLASFKKWAADVDVIYNASAAETGGERHVRFVTESDCTASVLNVQISDAEIQDFNASNRALAAQGFNRKDRKYMMFTDAKVYCGIGTFAGDERPGQDNLSNFGPSYGRTDSGCWSGSTAAHELGHNLGAVNNSAPNSSKAGHCTDEWDIMCYSDAPNYPQMRTVCPDRAQDDRLDCNHDDYYNTAPKPGSYLTTHWNVANNRFLIAGGGNGGGTGPSPTPTPTPTATPTRTPSPSPTPTGGPTATPTGSPTPTPTATPTPTATPTPTATPTPGNTGPDMTVSQVTQTSAMLSWNAAPAAAGYDVLLNGQPIGTVRSTVVGLVRLAPGTSYTVAVAVRDAAGAVGKPGRSVTFRTVADAGRPQPGAAYTLVNGLTGQAADLWGSSMNDGTVAIAYQRTGYANQKWQFEDAGSGAVRIKSARSGKCLQLGGAPVAGQYVAQQPCSDAAAQKWQLTSTDGGFTVTAGGGGLVLGLSDRWYYGGWLLELQQPNGRPYQSWSLLKTS

SEQ ID NO: 442 - protein, 317 aa, Streptomyces Sp.
MSTAETDRAATPAADPRVEVLPARDVPLGGPRAMTVRRTLPQRSRSTIGAWCFVDHYGPDDVTSTGGMDVAPHPHTGLQTVSWLFTGEIEHRDSLGVHAYVRPGEVNLMTSGRGIAHSEVSTPATTVLHGVQLWVALPEEHRHTGRDFHHHVPAPVALDGGEARVFLGTLAGDTSPVPTFTPLLGAELTLHPGATVTLDVDPAFEHGLLVDSGHVRLLDTPLRPAELGYAAPGRDTLTLTNTGDTDARLVLLGGTPFEEQIVMWWNFIGRSHEDIVQARDEWQAATDRFGAVQGYPGDRLPAPELPGLPLKPRGNAR

SEQ ID NO: 443 - protein, 317 aa, Streptomyces Sp.
MSTAETSLVEPNAADPHVEVLPARDVPLGGPRAMTVRRTLPQRSRTLIGAWCFVDHYGPDDVAGTGGMDVAPHPHTGLQTVSWLFTGEIEHRDSLGVHAYVRPGEVNLMTSGHGIAHSEVSTPATTVLHGVQLWVALPEEHRHTARDFHHHAPAPVALDGGEARVFLGSLAGDTAPVPTFTPLLGAELVLRPHATVTLDVDPAFEHGLLVDHGEIRFADTPLHAAELGYLAPGPATITLTNTTDSDARAVLLGGTPFEEQIVMWWNFIGRTHEDIAQARAEWQAAADRFGAVEGYPGDRLPAPELPGTPLKPRGRVR

SEQ ID NO: 444 - protein, 320 aa, Streptomyces Sp.
MSTAETDLTEPIAADPRVEVLPARDVPLGGPRAMTVRRTLPQRSRSLIGAWCFVDHYGPDDVAGTGGMDVAPHPHTGLQTVSWLFTGEIEHRDSLGVHAYVRPGEVNLMTSGHGIAHSEVSTPNTTVLHGVQLWVALPEEHRHTGRDFHHHAPAPVALDGGGEARVFLGTLAGDTSPVPTFTPLLGAELVLRPHATVTLDVDPGFEHGLLVDHGDIRFADTPLRRAELGYLAPGPTTITLTNTTDSDARAVLLGGAPFEEQIVMWWNFIGRSHEDITRAREEWMSSVNSDRFGEVHGYPGDRLPAPELPGTPLKPRGRLR

SEQ ID NO: 445 - protein, 321 aa, Streptomyces Sp.
MSTAETDLTEPNAAAAPRVEVLPARDVPLGGPRAMTVRRTLPQRSRTLIGAWCFVDHYGPDDVAGTGGMDVAPHPHTGLQTVSWLFTGEIEHRDSHGVHAYVRPGEVNLMTSGHGIAHSEVSTPDTTVLHGVQLWIALPAEHLHTARDFHHHAPAPVALDGGGEARVFLGTLAGDTSPVPTFTPLLGAEIHLRPHATVTLDVDPAFEHGLLVDHGDIRLAGTPLRRAELGYLAPGPTTITLTNTTDGDARAVLLGGTPFEEPIIMWWNFVGRSHEDITRAREEWMSSANPDRFGAVEGYPGDRLPAPELPSIPLKARGRAR

SEQ ID NO: 446 - protein, 284 aa, Kitasatospora Sp.
MSTAETDRAATPAADPRVEVLPARDVPLGGPRAMTVRRTLPQRSRSTIGAWCFVDHYGPDDVTSTGGMDVAPHPHTGLQTVSWLFTGEIEHRDSLGVHAYVRPGEVNLMTSGRGIAHSEVSTPATTVLHGVQLWVALPEEHRHTGRDFHHHVPAPVALDGGEARVFLGTLAGDTSPVPTFTPLLGAELTLHPAATVTLDVDPAFEHGLLVDSGHIRLLDTPLRPAELGYAAPGRDTLTLTNTGDTDARLVLLGGTPFEEQIVMWWNFIGRSHEDIVQARDEWQA

SEQ ID NO: 447 - protein, 115 aa, Streptomyces Sp.
MSQQAPDNTEGQTLPFWVDVVEEEGEDGNAMGGLFRHDGEAVLRSVPLGPLRKNLADTVDALQKVFEEVADRGGALPLAEAQLSFQVTATGGIQLIGSGQVQGTRGLTLTFKRPS

SEQ ID NO: 448 - protein, 206 aa, Streptococcus Sp.
MKGLVKAAVLTVTLGIGGAFYSSDASAHGYIKEPVSRAYMGALEKQTLGWTAAAQKYGSVIDNPQSVEGTKGFPAAGPPDGRIASANGGSGQIDFGLDKQTADYWVKQNIRGGFNTFTWYYTAPHATSKWHYYITKKNWNPNKPLSRDEFELIGTVNHDGSKADTNLTHKIFVPTDRSGYHVILGVWDVADTSNAFYNVIDVNLTQ

SEQ ID NO: 449 - protein, 206 aa, Bacillus Sp.
MKGLVKAAVLTVTLGIGGAFYSSDASAHGYIKEPVSRAYMGALEKQTMGWTAAAQKYGSVIDNPQSVEGPKGFPAAGPPDGRIASANGGSGQIDFGLDKQTADHWVKQNIRGGFNTFTWHYTAPHATSKWHYYITKKNWNPNKPLSRDEFELIGTVNHDGSKADTNLTHKIFVPTDRSGYHIILGVWDVADTSNAFYNVIDVNLTK

SEQ ID NO: 450 - protein, 206 aa, Bacillus Sp.
MKGLVKAAVLTVTLGIGGAFYSSDASAHGYIKDPASRAYMGALEKQTMGWTAAAQKYGSVIDNPQSVEGPKGFPAAGPPDGRIASANGGSGQIDFGLDKQTADHWVKQNIRGGFNSFTWNYTAPHATSKWHYYITKKNWNPNKPLSRDEFELIGTVNHDGSKADTNLTHRIFVPTDRSGYHIILGVWDVADTSNAFYNVIDVNLTQ

SEQ ID NO: 451 - protein, 206 aa, Bacillus Sp.
MKSLVKAAVLTVTLGVGGAFYSSDASAHGYIKDPVSRAYMGALEKQTMGWTAAAQKYGSVIDNPQSVEGPKGFPAAGPPDGRIASANGGSGQIDFGMDKQTADHWVKQNIRGGFNSFTWHYTAPHATSKWHYYITKKNWNPNKPLSRDEFELIGTVNHDGSKADTNLTHRIFVPTDRSGYHIILGVWDVADTSNAFYNVIDVNLTQ

SEQ ID NO: 452 - protein, 206 aa, Bacillus Sp.
MKKFIKGAILTAALGVGATFFASDASAHGYIKEPASRAYMGSLEKQIIGWSAAAQKYGSVIDNPQSVEGPKGFPAAGPPDGKIASANGGSGQIDFGLDRQTADYWAKQDLRGGLNTFTWHYTAPHATSKWHYYITKKNWNPNKPLTRDEFELIGTVNHDGSKADTNLSHKIFVPTDRSGYHVILGVWDVADTSNAFYNVIDVNLKQ

SEQ ID NO: 453 - protein, 206 aa, Bacillus Sp.
MKGFIKGAVLTAILGVGATLFAGDVSAHGYIKEPASRAYMGSLEKQIIGWTAANQKYGSVIDNPQSVEGPKGFPSAGPPDGKIASANGGSGQIDFGLDRQTADHWVKQNIRGGLNTFTWHYTAPHATSKWHYYITKKDWNPNKPLTRDEFELIGTVDHDGSKADTNLSHKIYVPTDRSGYHVILGVWDVADTSNAFYNVIDVNLMR

SEQ ID NO: 454 - protein, 206 aa, Bacillus Sp.
MKGFIKGAVLTAILGVGATLFAGDVSAHGYIKEPASRAYMGSLEKQIIGWTAANQKYGSVIDNPQSVEGPKGFPSAGPPDGKIASANGGSGQIDFGLDRQTADHWVKQNIRGGLNTFTWHYTAPHATSKWHYYITKKDWNPNKPLTRDEFELIGTVDHDGSKADTHLSHNIYVPTDRSGYHVILGVWDVADTSNAFYNVIDVNLIR

SEQ ID NO: 455 - protein, 206 aa, Bacillus Sp.
MKGFIKGAVLTAVLSVGATLFAGDVSAHGYIKEPASRAYMGSLEKQIIGWTAATQKYGSVVDNPQSVEGPKGFPAGGPPDGKIASANGGFGQIDFGLDRQTADHWVKQNMHGGLNTFTWHYTAPHATSKWHYYITKKDWNPNKPLTRDEFELIGTVDHDGSKADTNLSHKIYVPTDRSGYHVILGVWDVADTSNAFYNVIDVNLIQ

SEQ ID NO: 456 - protein, 206 aa, Salinibacillus Sp.
MKGFVKGAVLTAVLSVGATLFAGDVSAHGYIKEPASRAYMGSLEKQIIGWTAATQKYGSVVDNPQSVEGLKGFPAGGPPDGKIASANGGFGQIDFGLDRQTADHWVKQNMHGGLNTFTWHYTAPHATSKWHYYITKKDWNPNKPLTRDEFELIGTVDHDGSRADTNLSHKIYVPADRSGYHVILGVWDVADTSNAFYNVIDVNLIQ

SEQ ID NO: 457 - protein, 956 aa, unknown
  environmental sample
MKYSKLSLALAGLMGVAAISVVDDVMAMNYHVQGDRIFLSGDVTYADVVSLPALLAKAQAEGRPVREVVLRTSNGGALIAGEWLQGIIRTSGLNTIVSGNCISSCSIMQSGGVERYLAGDLPLIDSVQIHAASSGGKVIYTPSPRMTQIYTGNYGGGMDAGLLHKAMYEVVKPNGLLVFRDPARSTGSSVTFDPDGSGSKLESFPGQDIYSNRIITANGYRDPGDTLNVTANVTGDINPGYLRTGRQLQAFVDDDFARWNTDWRSTYINLAQSIYNASSKGPQGIGALSVQGYLSDPDIQDLLLSKLRLADLDVSTLDNAMGVIRVTNGATWRTSTTTGADFMLVDNGTIALEGGALRASEVRVLGAGMLVGHGDVAGTAMDRAALLDGTGPSYREDGFNRLRVFGTLMPRGGDLVTHGYVNIMPGGKVLFDVTENGGTTAGRLRVGTFFDDEQTEGALVISKGAFLELNVAQGYYGQDFRRDLVEGPIYQGGFEEAVRLGDTSYSASISGDVFRPRHNSLLSFNVKQTADGLWLTANPGFDQLGLFANGTSGDGLGRALATASDRQDKGLKSLLGALQFADRDVIAQQAGALRGDAHASLRLADTALVGSIGNVVQQHQSAMRSGGDADGLASQVAQSVSSQPGMRHGSLFNQLAMHLVEPAPGSVAGSGDAGRSHGIWARGFASHGRIDADGGVAGLSHNIGGIVVGADTRVADDRVTLGVSVAAADMSTKASDGSGFTGDVRALDVGGYLDATYARGYLSAAVRYTDLRHDTRRSIGGIDGLQQPLRAKYSNDAISARVEHAFSFTTGKGLVIQPLLPVVDYARTSATRFNEGQGAGALVGRSGSLESIRVGAGLQLFKTFEGNNGERITPRARVVWQKELGDSQARYSTGFAAAPDLVFGASSQAVGEQVLAWNVGVTSRASERLSIMADYVGERRDGQIQNGVMLGLGYRF

SEQ ID NO: 458 - protein, 956 aa, Stenotrophomonas Sp.
MKYSKLSLALAGLMGVAAISVVDDVMAMNYHVQGDRIFLSGDVTYADVVSLPALLAKAQAEGRPVREVVLRTSNGGALIAGEWLQGIIRTSGLNTIVSGNCISSCSIMQSGGVERYLAGDLPLIDSVQIHAASSGGKVIYTPSPRMTQIYTGNYGGGMDAGLLHKAMYEVVKPNGLLVFRDPARSTGSSVTFDPDGSGSKLESFPGQDIYSNRIITANGYRDPGDTLNVTANVTGDINPGYLRTGRQLQAFVDDDFARWNTDWRSTYINLAQSIYNASSKGPQGIGALSVQGYLSDPDIQDLLLSKLRLADLDVSTLDNAMGVIRVSNGATWRTSATTGADFMLVDNGTIALEGGALRASEVRVLGAGMLVGHGDVAGTAMDRAALLDGTGPSYREDGFNRLRVFGTLMPRGGDLVTHGYVNIMPGGKVLFDVTENGGTTAGRLRVGTFFDDEQTEGALVISKGAFLELNVAQGYYGQDFRRDLVEGPIYQGGFEEAVRLGDTSYSASISGDVFRPRHNSLLSFNVKQTADGLWLTANPGFDQLGLFANGTSGDGLGRALATASDRQDKGLKSLLGALQFADRDVIAQQAGALRGDAHASLRLADTALVGSIGNVVQQHQSAMRSGGDADGLASQVAQSVSSQPGMRHGSLFNHLAMHLVEPAPGSVAGSGDAGRSHGIWARGFASHGRIDADGGVAGLSHNIGGIVVGADTRVADDRVTLGVSVAAADMSTKASDGSGFTGDVRALDVGGYLDATYARGYLSAAVRYTDLRHDTRRSIGGIDGLQQPLRAKYSNDAISARVEHAFSFTTGKGLVIQPLLPVVDYARTSATRFNEGQGAGALVGRSGSLESIRVGAGLQLFKTFEGNNGERITPRARVVWQKELGDSQARYSTGFAAAPDLVFGASSQAVGEQVLAWNVGVTSRASERLSIMADYVGERRDGQIQNGVMLGLGYRF

SEQ ID NO: 459 - protein, 956 aa, Stenotrophomonas Sp.
MKYSKLSLALAGLMGVGAISVVDDVMAMNYHVQGDRIFLSGDVTYADVVSLPALLAKAQAEGRPVREVVLRTSNGGALIAGEWLQGIIRTSGLNTIVSGNCISSCSIMQSGGVERYLAGDLPLIDSVQIHAASSGGKVIYTPSPRMTQIYTGNYGGGMDAGLLHKAMYEVVQPNGLLVFRDPARSTGASVTFDPDGSGSKLESFPGQDIYSNKIITANGYRDPGDTLNVTANVVGDINPGYLRTGRQLQAFVDDDFARWNTDWRSTYINVAQSIYNASSRGPQGIGALSVQGYLSDPDIQDLLLSKLRLADLDVSTLDNAMGVIRVSNGATWRTSATTGADFMLVDNGTIALEGGALRASEVRVLGAGMLVGHGDVAGTAMDRAALLDGTGPSYREDGFNRLRVFGTLMPRGGDLVTHGYVNIMPGGKVLFDVTENGGTAAGRLRVGTFFDDEQTEGALVISKGAFLELNVAQGYYGQDFRRDLVEGPIYQGGFEEAVRLGDTGYSASISGEVFRPRHNSLLSFNVKQTADGLWLTANPGFDQLGLFANGTSGDGLGRALATASDRQDKGLRSLLGALQFADRDVIAQQAGALRGDAHASLRLADTALVGSIGNVVQQHQSAMRSGGDADGLASQVAQSVSSQPGMRHGSLFNQLAMHLVEPASGSVAGSADAGRSHGIWARGFASHGRLDADGGVTGLSHTIGGIVVGADTRVADDRVTLGVSVAAADMSTKASDGSGFTGDVRALDVGGYLDATYARGYLSAAVRYTDLRHDTRRSINGIDGLQQPLRAKYSNDAISARVEHAFSFTTGKGLVIQPLLPVVDYARTSATRFNEGQGAGALVGRSGSLESIRVGAGLQLFKTFEGNNGERITPRARVVWQKELGDSQARYSTGFAAAPDLVFGASSQAVGEQVLAWNLGVTSRASERLSIMADYVGERRDGQIQNGVMLGLGYKF

SEQ ID NO: 460 - protein, 957 aa, Stenotrophomonas Sp.
MKHSKLSLALAGLIGVGALAAADDVMAMSYHVQGDRIFLSGGVTYADVVSLPALLAKAQAEGRPIREVVLRTSNGGALIAGEWLQGVIRTAGLNTIVSGHCISSCSIMQSGGVERYLAGDLPIVDSVQIHAASNGGKVIYTPSPRMTQIYTGNYGGGMDAGLLHKAMYEVVQPNGLLVFRDPARTTGASITFDPDGSGSKLESFPGQDIYSNNIITANGYRDPGDTLNVSANVSGDINPGYLRTGRQLQTFVDDDFARWNTDWQSSYINLAQSIYNASSRGPQGIGPDSVQDYLNDPGIQALLLSKLRLADLDVSTLDNAMGVIRVSNGATWRTAATTGADFMLVDNGTIALEGGALRASEVRVLGAGMLVGHGDVAGTAMDLDALGSGSGPSWREDGFNRLRVFGTLMPRGGDLVTHGYVNIMPGGKLLFDVTENGGAATGRLRVGTFFDDEPTDGALVISKGAFLELNVAQGYYGQDFRRDLVQGPIYQGGFEDVVRLGDTGYSASIAAGDVFRPRHNSLLSFNVKQTADGLWLTANPGFDQLGLFANATSGDGLGRALATASARQDGNLKSLLGALQFADRDVIAQQAGALRGDAHASLRLADNALVGSIGNVVQQHQAAMRSGGDADGLASQAAQSVSAQPGMRHGSLFNQLAMHLVEPAAGGTASGSEAGRSRGLWARGFASHGRIDAEGGAAGLSHNIGGIVVGADTRLADDRVTLGVSVAAADMSTKGRDGSDFSGDVRALDVGGYLDATYSRGYLSAAVRYTDLRHDTRRSISGIDGLQQPLRAKYNNDAISARVEHAFSFTTGTGLVIQPLLPVVDYARTSATRFNEGQGAGALVGRSGSLESIRVGAGLQLFKTFEGNNGERITPRARVVWQKELGDLQARYSTGFAAAPDLVFGASSQAVGEQVLAWNLGVTSRASERLSIMADYVGERRDGQIQNGVMLGLGYRF

SEQ ID NO: 461 - protein, 957 aa, Stenotrophomonas Sp.
MKYSKLSLALAGLMGVGAIAAADDVMAMSYHVQDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGRITYAPSPRMTQIYTGNYGGGMDAGLLHKAMYEVVQPNGLLVFRDPARTTGTSVTFDPDGSGSKLESFPGQDIRSNSIINTAGYRDPGDTLRVTSNVSGDINPGYLRTARQLQAFVDDDFARWNTDWASTYINYAVSLYNFSTRGANGIGAQSLQQLLADPDLQDELRGQLRLADLDASTLANSAGVIRVSNGATWRTAETTGADFILVDNGTIALEGGALRTPELRVMPGSIVVGHGDIASVGTDSDALLDGTGPSYREDGFNRLRVFGTLMPRGGDLVTHGYVNIMPGGQVLFDVTEAGGTGSGRLRVGSFYDGGTEEGALVIAQGAHLALNVAQGFYAGAYRRDLVEGPIYQGGFQDVVRLGDAGYSASITAGEEFRPRHNSLLSFNVKQTADGLWLTANPGFDQLGLFANGTSGDGLGRALATASDRQDKGLRSLLGALQFADRDVIAQQAGALRGDAHASLRLADTALVGSIGNVVQQHQSAMRSGGDADGLASQVAQSVSSQPGMRHGSLFNQLAMHLVEPASDSVAGSGDAGRSHGIWARGFASHGRIDADGGVAGLSHTIGGIVVGADTRVADDRVTLGVSVAAADMSTKASDGSGFTGDVRALDVGGYLDATYARGYLSAAVRYTDLRHDTRRSINGIDGLQQPLRAKYSNDAISARVEHAFSFTTGKGLVIQPLLPVVDYARTSATRFNEGQGAGALVGRSGSLESIRVGAGLQLFKTFEGNNGERITPRARVVWQKELGDSQARYSTGFAAAPDLVFGASSQAVGEQVLAWNLGVTSRASERLSIMADYVGERRDGQIQNGVMLGLGYKF

SEQ ID NO: 462 - protein, 957 aa, Stenotrophomonas Sp.
MKYSKLSLALAGLMGVGAIAAADDVMAMSYHVQDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGRITYAPSPRMTQIYTGNYGGGMDAGLLHKAMYEVVQPNGLLVFRDPARTTGTSVTFDPDGSGSKLESFPGQDIRSSSIINTAGYRDPGDTLRVTSNVSGDINPGYLRTARQLQAFVDDDFARWNTDWASTYINYAVSLYNFSTRGANGIGAQSLQQLLADPDLQDELRGQLRLADLDASTLANSAGVIRVSNGATWRTAETTGADFILVDNGTIALEGGALRTPELRVMPGSIVVGHGDIASVGTDSDALLDGTGPSYREDGFNRLRVFGTLMPRGGDLVTHGYVNIMPGGQVLFDVTETGGTGSGRLRVGSFYDGGAEEGALVIAQGAHLALNVAQGFYAGAYRRDLVEGPIYQGGFQDVVRLGDAGYSASITAGEVFRPRHNSLLSFNVKQTADGLWLTANPGFDQLGLFANGTSGDGLGRALATASDRQDKGLRSLLGALQFADRDVIAQQAGALRGDAHASLRLADTALVGSIGNVVQQHQSAMRSGGDADGLASQVAQSVSSQPGMRHGSLFNQLAMHLVEPASGSVAGSADAGRSHGIWARGFASHGRIDADGGVAGLSHTIGGIVVGADTRVADDRVTLGVSVAAADMSTKASDGSGFTGDVRALDVGGYLDATYARGYLSAAVRYTDLRHDTRRSINGIDGLQQPLRAKYSNDAISARVEHTFSFTTAKGLVIQPLLPVVDYARTSATRFNEGQGAGALVGRSGSLESIRVGAGLQLFKTFEGNNGERITPRARVVWQKELGDSQARYSTGFAAAPDLVFGASSQAVGEQVLAWNLGVTSRASERLSIMADYVGERRDGQIQNGVMLGLGYKF

SEQ ID NO: 463 - protein, 957 aa, Stenotrophomonas Sp.
MKHSKLSLALAGLMGVTAMAAVDDVMAMNYHVRDDRVFLSGGVTVADVVALPALLAKAQAEGRPIREVVLRTSNGGALIAGEWLQAVIRTQGLDTIVSGHCISSCSIMQSGGVNRYLGGDLPLIDSVQIHAASSGGKITYAPSARMTQIYTGNYGGGMDAGLLHKAMYEVVQPNGLLVFRDPARTTGTSVTFDPDGSGSKLESFPGQDIRGNNIINTAGYRDPGDTLRVTSNVSGDINPGYLRTARQLQAFVDDDFARWNTDWASTYINDAVSLYNVSTRGANGIGAQSLQQLLADPDVQNELRGQLRLADLDASTLASSAGVIRVSNGATWRTAETTGADFILVDNGTIALEGGALRTPELRVMPGSIVVGHGDIASVGTDSDALLDGTGPSYREDGFNRLRVFGTLMPRGGDLVTHGYVNIMPGGQVLFDVTETGGTGSGRLRVGSFYDGGSEEGALVIAQGAHLALNVAQGFYAGTYRRDLVEGPIYQGGFQDAVRLGDAGYSASITAGEVFRPRHNSLLSFNVNQTADGLWLTANPGFDQLGLFANGTSGDGLGRALAAAADRQDSGLKSLLGALQFSDRDVIAQQAGALRGDAHASLRLADNALIGSIGNVVQQHQAAMRSGGDADGLASQAAQSVSAQPGMRHGSLFNQLAMHLVEPAGEAAGDSRVAGRSHGLWARGFASHGRIDADGGVAGLSHNIGGIVVGADTRVADDRVTLGVSVAAADMSTKASDGSGFSGDVRALDVGGYLDATYSRGYLSAAVRYTDLRHDTRRSVGGIDGLQQPLRAKYSNDAISARVGHAFSFTTGKGLVIQPLLPVVDYARTSATRFNEGQGAGALVGRSGSLESIRVGAGLQLFKTFEGNNGERITPRARVVWQKELGDSQARYSTGFAAAPDLVFGASSQAVGEQVLAWNLGVTSRASERLSIMADYVGERRDGQIQNGVMLGLGYRF

SEQ ID NO: 464 - protein, 957 aa, Stenotrophomonas Sp.
MKHSKLSLALAALLGITAMAAVDDVMAMNYHVQDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGRITYAPSPRMTQIYTGNYGGGMDAGLLHKAMYEVVRPNGLLVFRDPARTTGTSVTFDPDGSGSKLESFPGQDIRGNNIINTAGYRDPGDTLRVTSNVSGDINPGYLRTARQLQAFVDDDFARWNTDWASTYINYAVSLYNVSTRGPNGIGTQSLQQLLADPDLQDELRGQLRLADLDASTLAGSAGVIRVSNGATWRTAETTGADFMLVDNGTIALEGGALRTPELRVMPGSVVVGHGDIASVGTDSDALLDGTGPSWREDGFNRLRVFGTLMPRGGDLVTHGYVNIMPGGQVLFDVTEAGGTGSGRLRVGSFYDGGAEEGALVIAQGAHLALNVAQGFYAGGYRRDLVEGPIYQGGFQDAVRLGDTGYSASITAGEVFRPRHNSLLSFNVNQTADGLWLTANPGFDQLGLFANGTSGDGLGRALAAASDRQDSGLKSLLGALQFADRDVIAQQAGALRGDAHASLRLADNALLGSIGNVVQQHQTAMRSGGDADGLASQAAQSVSAQPGMRHGSLFNRLAMHLVEPAGEAAGDSRAAGGSRGLWARGFASHGRIDADGGVAGLSHNIGGIVVGADTHVADDRVTLGVSVAAADMSTKASDGSGFSGDVRALDVGGYLDATYSRGYLSAAVRYTDLRHDTRRSLSPIDGLQQPLRARYSNDAISARVEHAFSFTTGKGLVIQPLLPVVDYARTSATRFNEEQGAGALVGRSGSLESIRVGAGLQLFKTFEGNNGERITPRARVAWQKELGDSQARYSTGFAAAPDLVFGASSQAVGEQVLAWNVGVTSRASERLSIMADYVGERRDGQIRNGVMLGLGYRF

SEQ ID NO: 465 - protein, 962 aa, Stenotrophomonas Sp.
MKHSKLSIALAGLVGIATLGQMDDVMAMNYHVQGDRVVLSGGVTVADVVALPALLAKAQAEGRPIREVVLRTSNGGALIAGEWLQGVIRTNGLNTIVSGHCISSCSIMQSGGVERYLAGDLPLVDSVQIHAASNSGKVIYTPSPRMTEIYTGNYGGGMDAGLLHKAMYEVVQPNGLLVFRDPARTTGASVSFDPDGSGRRLETFPGQDIYSNNIITAAGYRDPGDTLTVTGNVSGDINPGYLRTARQLQAFVDDDFARWNDTDFATTYINYAVNIYNRSSAGPNGIGPASVQDYLNDPGTQQLLLGQLRLDELDASTLGNSAGVIRVAKGGTWRTAETTGADFMLVENGTIALEGGALRTPELRVLAAGMVVGHGDIASVATDSSALLNGTGPSYREDGFNRLRVYGTLMPRGGDLVTHGYVNIMPGGKVLFDVTEAGGSEAGRLRVGDFYDSGANEGALVISPGAHLELNVAQGFYAGNYQRELVSGPIYQGGFTDAVRLGDTGYTASITDGEVFRPRHNSLLSFNINQTAEGLSLTANPGFDQLAQLTGNNGNDGLGRALATAGQRQDAGLKPLLGALQFADRDVIAQQAGALRGDGHASLRLADSALVGSIGSVVQQHQAARRSGSGDAGGLAAQAAQAASAQPGMANGSLFNQLAMHLVEPAGTGGGSTNFAGEAPRSHGLWGRGFGSHGRIDGEGGVAGLSHTVGGIVLGADTQLADDRVTLGVSVAAADMSTKGRDGSGFSGDVRALDVGGYLDATYSRGYLSASVRYTDLRHDTRRSIDGIDGLQGPLRAKYNNDAISARLEHGFSFTTAKGVVIQPLLPVVDYARTSATRFNEGQGAGALVGRGDSLESIRVGAGLQVFKTFEGNNGERITPRARVVWQKELGDTQARYSTGFAAAPDLVFGASSQTVGEQVLAWNLGVTSRATDRLSVMVDYVGERRDGQLQNGVMLGLGYTF

SEQ ID NO: 466 - protein, 962 aa, Stenotrophomonas Sp.
MKHSKLSIALAGLVGIATLGQMDDVMAMNYHVQGDRVVLSGGVTVADVVALPALLAKAQAEGRPIREVVLRTSNGGALIAGEWLQGVIRTNGLNTIVSGHCISSCSIMQSGGVERYLAGDLPLVDSVQIHAASNSGKVIYTPSPRMTEIYTGNYGGGMDAGLLHKAMYEVVQPNGLLVFRDPARTTGASVSFDPDGSGRRLETFPGQDIYSNNIITAAGYRDPGDTLTVTGNVSGDINPGYLRTARQLQAFVDDDFARWNDTDFATTYINYAVNIYNRSSAGPNGIGPASVQDYLNDPGTQQLLLGQLRLDELDASTLGNSAGVIRVAKGGTWRTAETTGADFMLVENGTIALEGGALRTPELRVLAGGMVVGHGDIASVATDSSALLNGTGPSYREDGFNRLRVYGTLMPRGGDLVTHGYVNIMPGGKVLFDVTEAGGSQAGRLRVGDFYDSGANEGALVISPGAHLELNVAQGFYAGNYQRELVSGPIYQGGFTDAVRLGDTGYTASITDGEVFRPRHNSLLSFNINQTAEGLSLTANPGFDQLAQLTGNNGNDGLGRALATAGQRQDAGLKPLLGALQFADRDVIAQQAGALRGDGHASLRLADNALVGSIGSVVQQHQAARRSGSGDAGGLAAQAAQAASAQPGMANGSLFNQLAMHLVEPAGAVGGSTNFGGEVPRSHGLWGRGFGSHGRIDGEGGVAGLSHTVGGIVLGADTQLTDDRVTLGVSVAAADMSTKGRDGSGFTGDVRALDVGGYLDATYSRGYLSASVRYTDLRHDTRRSIDGIDGLQGPLRAKYNNDAISARLEHGFSFTTANGVVIQPLLPVVDYARTSATRFNEGQGAGALVGRGDSLESIRVGAGLQVFKTFEGNNGERITPRARVVWQKELGDTQARYSTGFAAAPDLVFGASSQTVGEQVLAWNLGVTSRATDRLSVMVDYVGERRDGQLQNGVMLGLGYTF

SEQ ID NO: 467 - protein, 957 aa, Stenotrophomonas Sp.
MKHSKLSLALAALLGITAMAAVDDVMAMNYHVRDDRVFLSGGVTVADVVALPALLAKAQAEGRPIHEVVLRTSNGGALIAGEWLQAVIRTQGLDTIVSGHCISSCSIMQSGGVNRYLGGDLPLVDSVQIHAASSGGRITYAPSPRMTQIYTGNYGGGMDAGLLHKAMYEVVRPNGLLVFRDPARTTGTSVTFDPDGSGSKLESFPGQDIRGNNIINTAGYRDPGDTLRVTSNVSGDINPGYLRTARQLQAFVDDDFARWNTDWASTYINYAVSLYNVSTRGPNGIGTQSLQQLLADPDLQDELRGQLRLADLDASTLASSAGVIRVSNGAPWRTAETTGADFMLVDNGTIALEGGALRTPELRVMPGSVVVGHGDIASVGTDSDALLDGTGPSYREDGFNRLRVFGTLMPRGGDLVTHGYVNIMPGGQVLFDVTEAGGTGSGRLRVGSFYDGGAEEGALVIAQGAHLALNVAQGFYAGGYRRDLVEGPIYQGGFQDAVRLGDTGYSASITAGEVFRPRHNSLLSFNVNQTADGLWLTVNPGFDQLGLFANGTSGDGLGRALAAASDRQDSGLKSLLGALQFTDRDVIAQQAGALRGDAHTSLRLADNALLGSIGNVVQQHQAAMRSGGDADGLASQAAQSVSAQPGMRHGSLFNQLAMHLVEPAGEAAGDSRAAGGRRGLWARGFASHGRIDADGGVAGLSHNIGGIVVGADTHVADDRVTLGVSVAAADMSTKASDGSGFSGDVRALDVGGYLDAIYSRGYLSAAVRYTDLRHDTRRSLSAIDGLQQPLRARYSNDAISARVEHAFSFTTGKGLVIQPLLPVVDYARTSATRFNEGQSAGALVGRSGSLESIRVGAGLQLFKTFEGNNGERITPRARVVWQKELGDSQARYSTGFAAAPDLVFGASSQAVGEQVLAWNAGVTSRASERLSIMADYVGERRDGQIQNGVMLGLGYRF

SEQ ID NO: 468 - protein, 996 aa, Stenotrophomonas Sp.
MAPDSIVNAFMFRGLVRWGSLRRPDVELLTRVLRVEREHMKHSKLSLALAGLMGITAMAAVDDVMAMNYHVRDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGKITYAPSARMTQIYTGNYGGGMDAGLLHKAMYEVVQPNGLLVFRDPARTTGTSVTFDPDGSGSKVESFPGQDIRGNNIINTAGYRDPGDTLRVTSNVSGDINPGYLRTARQLQAFVDDDFARWNTDWASTYINYAVSLYNVSTRGPNGIGTQSLQQLLADPDLQEELRGQLRLADLDASTLASSAGVIRVSNGATWRTAETTGADFILVDNGTIALEGGALRTPELRVMPGSIVVGHGDIASVGTDSDALLDGTGPSYREDGFNRLRVFGTLMPRGGDLVTHGYVNIMPGGQVLFDVTETGGTGSGRLRVGSFYDGGSEEGALVIAQGAHLALNVAQGFYAGTYRRDLVEGPIYQGGFQDAVRLGDAGYSASITAGEVFRPRHNSLLSFNVNQTADGLWLTANPGFDQLGLFTNGTSGDGLGRALAAASDRQDSGLKSLLGALQFADRDVIAQQAGALRGDAHASLRLADNALIGSIGNVVQQHQSAMRSGGDADGLASQAAQSVSAQPGMRHGSLFNQLAMHLVEPAGEAAGDSRVAGRSHGLWARGFASHGRIDADGGVAGLSHNIGGIVVGADTRVADDRVTLGVSVAAADMSTKASDGSGFSGDVRALDVGGYLDATYSRGYLSAAVRYTDLRHDTRRGVGGIDGLQQPLHARYSNDAISARVEHAFSFTTGKGLVIQPLLPVVDYARTSATRFSEGQGAGALVGRSGSLESIRVGAGLQLFKTFEGNNGERITPRARVVWQKELGDTQARYSTGFAAAPDLLFGASSQAVGEQVLAWNLGVTSRASERLSIMADYVGERRDGQIQNGVMLGLGYRF

SEQ ID NO: 469 - protein, 996 aa, unknown
  environmental sample
MVHDFIVNAFMFRGPVRWGRSRHPDVELLTRVLRVEREHMKHSKLSLALAGLMGITAMAAVDDVMAMNYHVQDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGRITYAPSPRMTQIYTGNYGGGMDAGLLHKAMYEVVAPNGLLVFRDPARTTGTSVTFDPDGSGSKLESFPGQDIRGNNIINTAGYRDPGDTLRITSNVSGDINPGYLRTARQLQAFVDDDFARWNTDWASTYINYAVSLYNVSTRGPNGIGAQSLQQLLGDPDLQDELRGQLRLADLDVSTLANSAGVIRVSNGATWRTAETTGADFMLVDNGTIALEGGALRTPELRVMPGSVVVGHGDIASVGIDTDALLDGTGPSWREDGFNRLRVFGTLMPRGGDLVTHGYVNIMPGGQLLFDVTEAGGTGSGRLRVGSFYDDGAEEGALVIAQGAHLALNVAQGFYAGAYRRDLVEGPIYQGGFQDVVRLGDAGYSASITGGEVFRPRHNSLLSFNVNQTADGLWLTANPGFDQLGLFANGTSGDGLGRALAAASDRQDSGLKSLLGALQFTDRDVIVQQAGALRGDAHASLRLADNALLGSIGNVVQQHQAAMRSGGDADGLASQAAQSVSAQPGMRHGSLFNQLAMHLVEPAGEGTGGGGATGRSHGLWARGFASHGRIDADGGVGGLSHNIGGIVVGADTRLADDRVTLGASVAAADMSTKASDGSGFSGDVRALDVGGYLDATYSRGYLSAAVRYTDLRHDTRRSLSAIEGLQQPLRARYSNDAISARVEHAFSFTTGKGLVIQPLLPVVDYARTSATRFNEGQGAGALAGRSGSLESIRVGAGLQLFKTFEGNNGERITPRARVVWQKELGDSQARYSTGFAAAPDLVFGASSQAVGEQVLAWNVGVTSRASERLSIMADYVGERRDGQIQNGVMLGLGYRF

SEQ ID NO: 470 - protein, 807 aa, unknown
  environmental sample
TGNYGGGMDAGLLHKAMYEVVQPNGLLVFRDPARTTGTSVTFDPDGSGSKLETFPGQDIRGNNIINTAGYRDPGDTLRVTSNVSGDINPGYLRTARQLQAFVDDDFARWNTDWASTYINYAVSLYNVSTRGPNGIGTPSLQQMLADPDLQDELRGQLRLADLDASTLASSAGVIRVSNGATWRTAETTGADFMLVDNGTIALEGGALRTPELRVMPGSVVVGHGDIASVGTDSDALLDGTGPSYREDGFNRLRVFGTLMPRGGDLVTHGYVNIMPGGQVLFDVTETGGTGSGRLRVGSFYDGGSEEGALVIAQGAHLALNVAQGFYAGTYRRDLVEGPIYQGGFQDAVRLGDTGYSASIAAGEVFRPRHNSLLSFNVNQTADGLWLTANPGFDQLGLFTNGTSGDGLGRALAAASDRQDSGLKSLLGALQFADRDVIAQQAGALRGDAHASLRLADNALIGSIGNVVQQHQAAMRSGGDADGLASQAAQSVSSQPGMRHGSLFNQLAMHLVEPAGEGPGDSRTASGSRGLWARGFASHGRIDADGGVAGLSHNVGGIVIGADTRVADDRVTLGVSVAAADMSTKASDGSGFSGDVRALDVGGYLDATYSRGYLSAAVRYTDLRHDTRRSVGGIDGLQQPLRAKYSNDAISARVEHAFSFTTGKGLVIQPLLPVVDYARTSATRFNEGQGAGALVGRSGSLESVRVGAGLQLFKTFEGNNGERITPRARVVWQKELGDTQARYSTGFAAAPDLLFGASSQAVGEQVLAWNLGVTSRASERLSIMADYVGERRDGQIHNGVMLGLGYRF

SEQ ID NO: 471 - protein, 961 aa, unknown
  environmental sample
MKQSKLSLALAGLIGVGVMVKADDAMAMNYHVQGDRIFLSGGVTFADVVSLPALLAKAQAEGRPIREVVLRTSNGGALIAGEWLQGVIRTSGLNTIVSGHCISSCSIMQSGGVERYLAGDLPIVDSVEIHAANNGSNVIYEPSPRMTQIYTGNYGGGMDAGLLHKAMYEVVKPNGLLVFRDPARTPGTSVTFDPDGSGSALESFPGQDIHSNRIITATGYRDPGDTLNVTADVTGDINPGYLRSGRQLQTFVDDDFARWSTDRPSAYFSYALTIYNLSSTGPQGIGAGSVQDYLSDPGVQALLLSKLRLGDLDASTLDDSMGVIRIANGAVWRSSATTGADFMLVDNGTIALEGGALRAPEVRVLGAGMLVGHGDVAGTAMDSTALLGGTGPSWREDGFNRLRVFGTLMPRGGDLVTHGYVNIMPGGKVLFDVTESGGSAGGRVRVGNFFDPSTNKVLDGALVISKGAFLELNVAQGYYSKDFRRDLVEGPIYQDGFQEVVRLGDTGYRASISGGEVFRPRHNSLLSFNVRQTADGLWLTANPGFDQWDLFANGPSGDDLGRVLGAASDRQDSGLKPLLGALQFADRDVVAQQAGALRGDAHATLRLADNALLGSIGNVVQQHQAAMRSAGGDADGLAAQVAQSMSAQPGMRHGTLFNQLAMHLVEPTAAGAGASGDGQRGHGLWARGFASHGRIDADAGVAGMSHTVGGIVVGADTRLADDRVGLGVSVAAADMSTKARGASSFTGDVRALDVGGYLDAIYARGYLSAAVRYTDLRHDTRRSIAGIEGLQDPLRAKYSNDAISARVEHAFSFTSGKGVVIQPLLPVVDYARTSATRFNEGQGVAALAGRGGSLESIRVGAGLQLFKTFEGNNGERITPRARVVWQKELGDTQARYSTGFAAAPDLVFGSNSQTVGEQVLSWNLGVTSRASERLSVMVDYVGERRDGQLQNGVQLGLGYRF

SEQ ID NO: 472 - protein, 683 aa, Streptomyces Sp.
MTRTRLTALAATAALAATGDLMIAAPASAAVTCASPVWKAQYFGNSTFSGTPKLTACDSAVNENYGYGDPAGVTLPKDNFSVRWSLTRDFGSGGPFRLSAATQDGMRVYVDGVQKINLWKNVSTTARKTVDLTVPAGKHTLRVDYVAWTGLAHATFTYAPRTEATVDTVRPLAPTGLTAAYNRDTAKTTLRWAANKEMDLAGYRVYRRLGTAQWVRAGGSSLLASPSFVDATPATGQTFLYEVRAVDKAGRESVGSLDATAVTVDRTGPAAPTGLTVTGDAWWATLAWQGAADAATYEVYAASAATGPFEPLGTTTTTSYRTDAPVNTARFYRVRALDALGNPSAYAAVTGDGVDRTPPKSPTSLGSVVRVGYTDVYWKQPDGFYEDFDNGGAYRVYRSPGKALDPAALTRVTCAEESDETSTGGLCHDLDMPAGTYVTYAVAAVDPAGNESALSAPLVVRTGDRVAPGPVTGVTATPRADGVLMSWAASTEDDVERYVVWTGVRQADGTVKWLSSTSCREGTSDPLAVLCGDLPDGETYVYAVVARDLWGNALPPSDPKVTVVQATELDVRPSLTVTRDWDLGSLGHGTVIGGPDEDGPSISWRCDNTAECDSVAGYRVSRWNAAAQAYEPLHAGLLPAQTRSYTDTAAARGTTHFYTLEAVRADGGVAGTYVWNCVFQDRV

SEQ ID NO: 473 - protein, 685 aa, Streptomyces Sp.
MTRIRLTVLAATATLATTGGLITAAPASAAVTCASSVWRAQYFGNSTFSGTPKLTACDSVIAEDYGYGDPPGVTLPKDNFSVRWSLTRDFGSGGPFRLAAATQDGMRVYVDGVRKINLWKNVSTTARKTVDLTIPAGKHTLRVDYVAWTGRANAGFTYAPRTEAAVDTVKPLAPTGLTAAYDRDTTKTTLRWAANKEMDLAGYRVYRRLSTTQWAKVSGSSLLTASSFVDATPATGQTFLYEVRAVDKAGRESAGSPDATAVTVDRTGPATPTGLTVVGDAWWANLAWQGVADAATYEVHAAPAASGPFEPLGTTTTTSYRTTAPENTVRHYRVRALDALGNPSAYADVTGDGVDRTPPKSAPTSLDSIAEVGYTDVYWKQPDGFYEDFDNGGTYRVYRSPGKTLDPAALTRVTCAEESSDETSTGGVCHDLDMPAGTYVTYAVAAVDPAGNESALSAPLVVRTGDRVAPGPVTGVKATPRADGVLMSWAASTEDDVERYAAWTGARQADGTVKWLGSSSCREGTSDPLAVLCGDLPDGETYVYAVVARDRWGNALPPSDPKVTVVEATELDVRPSVTVTRDWDLGSMGYGTVIGGPDEDGPSINWRCDRTADCDTVAGYRVGRWNAATKAYEPLHAGLLPAETRAYTDTTAARGTTHFYTLEAVRADGSVAGTHVWGCVFQDRV

SEQ ID NO: 474 - protein, 685 aa, Streptomyces Sp.
MTRIRLTVLAATATLATTGGLITAAPASAAVTCASSVWRAQYFGNSTFSGTPKLTACDSAIAEDYGYGDPPGVTLPKDNFSVRWSLTRDFGSGGPFRLAAATQDGMRVYVDGVRKINLWKNVSTTARKTVDLTIPAGKHTLRVDYVAWTGRANAGFTYAPRTEAAVDTVKPLAPTGLTAAYDRDTTKTTLRWAANKEMDLAGYRVYRRLSTTQWAKVSGSSLLTSSSFVDATPATGQTFLYEVRAVDKAGRESAGSADATAVTVDRTGPATPTGLTVVGDAWWANLAWQGVADAATYEVYAAPAASGPFELLGTTTTTSYRTTAPENTVRHYRVRALDALGNPSAYADVTGDGVDRTPPKSAPTSLDSIAEVGYTDVYWKQPDGFYEDFDNGGTYRVYRSPGKTLDPAALTRVTCAEESSDETSTGGVCHDLDMPAGTYVTYAVAAVDPAGNESALSAPLVVRTGDRVAPGPVTGVKATPRADGVLMSWAASTEDDVERYAAWTGARQADGTVKWLGSSSCREGTSDPLAVLCGDLPDGETYVYAVVARDRWGNALPPSHPKVTVVDATELDVRPSVTVTRDWDLGSMGYGTVIGGPDEDGPSINWRCDRTADCDTVVGYRVGRWNAATKAYEPLHAGLLPAETRAYTDTTAARGTTHFYTLEAVRADGSVAGTHVWGCVFQDRV

SEQ ID NO: 475 - protein, 680 aa, Streptomyces Sp.
MTRTRLSALAATAALATTGGLITAAPASAAVTCTSPVWRAQYFGNSTFSGTPKLTACDTAISENYGYGDPAGVTLPKDNFSVRWSLTRDFGSGGPFRLSAATQDGMRVYVDGVRKIDLWKNVSTTARKTVDLTIPAGKHTLRVDYVAWTGAANAAFTYTPRTEAAVDTVKPLAPTGLTAAYDRTTAKTTLRWTANKEMDLAGYRVYRRLSATSWAKVSGTSLLTTRSFVDAPPATGQTFLYEVRAVDKAGRESTGSPDVTATTVDRTGPAAPTGLTVATGDGWWDTLNWQGVADTAKYEVYASSAAAGPFELRGTTTTTSYRTSGAVNTNTYYRVRALDAAGNPGAYATVTSDGVDRMPPKSPTGVTAGARPGYTNVHWSQPDGFYEDWDNGGHYRVYRSPGKTFDPTARTQVTCVAEESHEASNGGNCYDVDMPANTYVTYAVTAVDPYGNESAYSAPVVVRTGDTVAPGPVTGVKVTPRNDGMLVSWAASPEDDIDEYVVWTGVRQADGTVKWLRPATCAEGTSNWLAILCGNLPDGEAHVYAVTAKDHWGNTLHPSDPKVTVVEATELDVRPSVTVTRDWSLGSLGHNRTTTRPSVDWQCTDTTRCATVTGYRVSRWNPVTKAYEPQHDGLLPADARTWEDATATKGNTYFYTLEAVTADGAVVGTYPWYTVFQDRV

SEQ ID NO: 476 - protein, 680 aa, Streptomyces Sp.
MTRTRLSALAATAALAATGGLITAAPASAAVTCTSPVWRAQYFGNSTFSGTPKLTACDTAISENYGYGDPAGVTLPKDNFSVRWSLTRDFGSGGPFRLSAATQDGMRVYVDGVRKIDLWKNVSTTARKTVDLTIPAGKHTLRVDYVAWTGVANAAFTYTPRTEAAVDTVKPLAPTGLTAAYDWTTAKTTLRWTANKEMDLAGYRVYRRLSATSWVKVSGTSLLTTRSFVDAPPATGQTFLYEVRAVDKAGRESAGSPDVTATTVDRTGPAAPTGLTVATGDGWWDTLKWQGVADTAKYEVYASSAAAGPFELRGTTTTPSYRTSGAVNTNTYYRVRALDAAGNPGAYATVTSDGVDRMPPKSPTGVTAGARPGYTNVHWSQPDGFYEDWDNGGHYRVYRSPGKTFDPTARTQVTCVAEESHEAGNGGNCHDVDMPANTYVTYAVTAVDPYGNESAYSAPVVVRTGDTVAPGPVTGVKVTPRNDGMLVSWAASPEDDIDEYVVWTGVRQADGTVKWLGPATCAEGTSNWLAILCGDLPDGEAHVYAVTAKDHWGNTLHPSDPKVTVVEATELDVRPSVTVTRDWSLGSLGHNRTTTRPSVDWQCTDTTRCATVTGYRVSRWNPVTKAYEPQHDGLLPADARTWEDATATKGNTYFYTLQAVTADGAVVGTYPWYTVFQDRV

SEQ ID NO: 477 - protein, 680 aa, Streptomyces Sp.
MTRTRLSALAATAALATTGGLITAAPASAAVTCTSPVWRAQYFGNSTFSGTPKLTACDTAISENYGYGDPAGVTLPKDNFSVRWSLTRDFGSGGPFRLSAATQDGMRVYVDGVRKIDLWKNVSTTARKTVDLTIPAGKHTIRVDYVAWTGVANAALTYTPRTEAAVDTVKPLAPTGLTAAYDWTTAKTTLRWTANKEMDLAGYRVYRRLSAANWAKVSGTSLLTTRSFVDAPPATGQTFLYEVRAVDKAGRESTGSPDVTAATVDRTGPAAPTGLTVATGDGWWDTLNWQGVADTAKYEVYASSAAAGPFELRGTTTTTSYRTSGAVNTNTYYRVRPLDAAGNPGAYATVTSDGVDRMPPKSPTGVTAGARPGYTNVHWSQPDGFFEDWDNGGHYRVYRSPGKTFDPTARTQVTCVAEESDEASNGGNCYDVDMPANTYVTYAVTAVDPYGNESAYSAPVVVRTGDTVAPGPVTGVKVTPRNDGMLVSWAASPEDDIDEYVVWKGVRQADGTVKWLGPDTCSEGTSNWLAILCGNLPDGETHVYAVMAKDHWGNTLHPSDPKVTVVEATELDVRPSVTVTRDWSLGSLGHNRTATRPSVDWQCTDTARCATVTGYRVSRWNPATKAYEPQHDGLLQADARTWEDATATKGNTYFYTLEAVTADGAVVGTYPWHTVFQDRV

SEQ ID NO: 478 - protein, 681 aa, Streptomyces Sp.
MTRTRLSALAATAALATTGGLVTAAAPASAAVTCTSPAWKAQYFGNSTFSGTPKLTACDTAISESYGKGDPAGVTLPKDNFSVRWSLNRDFGSGGPFRLSAATQDGMRVYVDGVRKINLWKNVSATVRKTVDLTIPAGKHTIRVDFVAWTGVANAAFTYTPRTEAAVDTVKPLAPTGLTAAYDRTTARTTLRWAANKEMDLAAYRVYRRLSTTSWAKVSGTSALTTRSFVDAPPATGQTFLYEVRAVDKAGRESTGSPDVTATTVDRTGPAAPTGLVVTTGDGWHDTLNWQKAADAAKYEVYASPAPTGPFELRGTTTTTSYRTNGAVNKNTYYRVRALDAVGNPGAYAAVTSDGVDRMPPKSPTDLNVVARPGYTDLHWHQPDSFTEDYDNGGYYRVYRSPGKTFDPAARTQVTCAAEESDDAGNGGNCYDVDMPTNTYVTYAVTAVDPYGNESAYSAPLVVRTGDTVAPGPVTGVKVTPRNDGMLVSWAASPEDDIDEYVVWKGARQADGTVTWLGPDTCSEGTSNWLAILCGNLPDGQTHVYAVVAKDHWGNTLHPSDPKVTVVAATERDVRPSVTVTRDWSLGSLGHNRTATRPSIDWQCTDTARCATVTGFRVSRWNPTAKAYEPQHDGLLPAGARTWEDATATKGDTYFYTLEAVTADGTVVGTYPWYIVFQDRV

SEQ ID NO: 479 - protein, 659 aa, Streptomyces Sp.
MTAAPATAAVTCISPVWKAQYFGNSTFSGTPKRTACDTAISESYGRGDPAGVTLPKDNFSVRWSLERDFGSGGPFRLSAATQDGMRVYVDGVRKIDLWKNVSTTARKTVDLTIPAGKHTIRVDYVAWTGVANAAFTYTPRTEAAVDTVKPLAPTGLTAAYDGATTRTTLRWSANKEMDLAGYRVYRRLSTTSWAKVSGTPLLTTRSFADAPPATGQTFLYEVRAVDKAGRESTGSPDVTATTIDRTGPAAPTGLVVTTGDGWYDTLNWQKAADTAKYEVYASLVPTGPFELRGTTTATSYRTDGTVNKNTYYRVRALDAAGNPGAYASVTSDGVDRMSPQSPTGLNVVARPGYTDLYWHQPDSFSEDYDNGGYYRVYRSPGKTFDPAARTQVTCVAEQSDDAANGGNCYDMGMPANTYVTYAVTAVDPYGNESAYSAPLVVRTGDTVAPGPVTGVKVTPRNDGTLVDWAASPEDDIDEYVVWKGVRQADGTVKWLGPDTCSEGTSNWLAILCGNLPDGETHVYAVVAKDHWGNTLHPRDPKVTVAEVTELDVRPSVTVTRDWSLGTLGHNRTATRPSVDWQCTDTTRCAAVSGYRVSRWNPAAKTYEPQHDGLLPAGSRTWQDATATKGNTYFYTLEAVTADGTVVGTYPWYTVFQDRV

SEQ ID NO: 480 - protein, 688 aa, Streptomyces Sp.
MVQKGPSLLMTRTQLSALAATAALATTGGLINAAPASAAVTCASPVWKAQYFGNSTFSGTPKLTVCDSAISENYGYGDPAGVTLPKDNFSVRWSLTRDFGSGGPFRLSAATQDGMRVHVDGVRKIDLWKNVSTTARKTVDLTLPAGKHTIRVDYVAWTGVANAAFTYTPRTEAAVDTVRPLAPTGLTAAYGRDTARTTLRWAANKEMDLAGYRVYRRLSATSWAKVSGTSLLTTPSFVDASPATGQTFLYEVRAVDKAGRESTGSPDVTATTVDRTGPVAPTGLTVVSDAWWAALSWQAVTDAAKYEVYASPEAVGPFTLLGTTTTASYRTDAPPNALRYYRVRGVDALGNPGAYATVTGDGVDRTPPEAPTGLNSYAVPASTSVNWTAPGGRWVEDWDNGGHYRVYRSPGKTFDPAARTAVACAEGSDEAGNGGRCVDLGMPVNTYVTYAVTAVDPDGNESAYSAPLVVRTGDTVAPGPVSGVKVTPRADGMLVSWAASPEDDIDEYVVWAGVRQADGTVKWLGPDTCAEGTSNPLAILCGGLPDGETRVYAVMAKDRWGNTLHPSDPKVTVVEATELDVRPSVTVTRDWNLGRLSHNATATRPSVDWQCTDTARCATVTGYRVSRWNPVTEAYETQHDGLLPADARTWADTTATKGNTYFYTLEAVTADGAVVGTYPWYTIFQDRV

SEQ ID NO: 481 - protein, 616 aa, Streptomyces Sp.
MGSGDPAGVTLPNDNFSIRWSVTRDFGSGGPFRLSAATQDGMRVYVDGVRKIDLWQNVSTTVRKAVDLTIPAGRHTIRVDYVAWTGYAYAGFTYLPRTEASVDTVKPLAPTGLTAAYSRDTAKTTLRWSSNKEMDLAGYRVYRRLSNTPWAQVSGSSLLTTPSFVDAPPATGQTFLYEVRAVDKAGRESTGSLDVTAATVDRTGPAAPTGFTVVSDAWLATLNWQAVADAAKYEVYASSAATGPFELLTTTTTTSYRTSAPTNANQYYRVRGIDASGNPGAYATVAGDGVDRTPPGSPTGLNSVARPGSTAVYWTAPGGRWVEDWDNGGHYRVYRSPGKTFDPAARTEVACAEEGSNEAGNGGACVDLDMPENTYVTYAVTAVDPDDNESAYSAPLVVRTGDTVAPGPVTSVKVTPRSDGMLVSWAASPEDDIDEYVVWAGARQADGAVKWLGPDRCWEGVSNPLAIVCGNLPDGETRVYAVIAKDHWGNGLHPSDPKITAVEATELDVRPSVTVTRDWNLGSLSHNPAATRPSVDWQCTDTTQCGAVTGYRVNRWNPATKAYDPQHDGLLPADARTWTDLTATKGNTYFYTLEAVTADGAVVGTYPWYTIFQDRV

SEQ ID NO: 482 - protein, 755 aa, Streptomyces Sp.
MRIPLGTTRRTGGAAALSLATALAGLAFPTTAHAAVTCSAGVWKAQYYANTTLSGTPKATVCDSAVAENYGSGDPSGVTLPNDNFGVRWTTTRNFGSGGPFNLSLAVQDGARVYLDGSRKIDLWRNVTSTQRKTVRLTIPRGTHTLRVDFAAFTGTANVAFSYAPVIGATYDKTVPLAPVGVKSGFSASTLKTTLTWSRNYEMDLAGYRVYRRVAGTSSWSLRNSTLITGSTFTEAPPATGAAYEYALRAVDRSGNVSPLSAVTSVVSADRTAPAVPTGLTATYDPSAGARLAWSPVSGASSYEVQRAVAPEGPFAPVGTPLQGAVLTDPAAAAGTTYFYRVRAKDGAGNASAYSTSVRLDAAEAKPLPPTAVSATGLPDRNTVGWQYDGDASHRFHVSGADSAAGPWTRLTDTPVTGTSYDDYAAPVGEARYYQVSTVTTLGTESDPSTTASATRIRDVTPPHMPYGLDAWDATDGVHLVWTPNTDDTDHYLVMRKSMFGAWEQIAVVRDGKYLDTGTAPDVQFGYTVRAVDGAGNVSPLPEPGYGTVYGKRLPVYEKPAAPASVTATADNGNVKVEWTPSTSTDVAGYYVYRTTVADPTTAYSVSPFITGTTFTNVDVPAGNSWYYVVRVVSTHSQWSDYSPMAQVTVPCPVLTGPPTPRITGGGRGADYAQLNWQVGACDQGATVSYNVYRSTSSADVFTPEHRIATGVTALTYKDPGLARAYYYYVVTAVAADGTESAPQATPFGISMMAP

SEQ ID NO: 483 - protein, 755 aa, Streptomyces Sp.
MRISLGAARRTGGAAVLSLATVLAGLAFPTTAHAAVNCSAGVWKAQYYANTTLSGTPKATVCDTAIAENYGSGDPSGVSLPSDYFGVRWTTTRNFGSGGPFDLSVAVQDGARVYVDGYRKIDLWRNVSSTQRKTVRFTMPRGTHTLRVDFAAFTGTANVSFSYKPVIGATYDKTAPLAPVGVKSSYSASTLKTTLTWSRNYEMDQAGYRVYRRVAGSSGWSLRNSTLITGTTFTDTPPATGAAYEYALRAVDRSGNVSALSAVTSVVSADRTAPAVPTGLTATYDPSAGARLSWSPVSGANSYEVQRAVAPEGPFASAGTPTQSAALTDPSAAVGTTYYYRVRAKDSAGNASAYSAPIQLDATEAKPLPPTAVSANGWVDRNSVGWRYDGDASHRFHVYAAEAAAGPWTRLTETPVTGPGYDDYAAPVGEVRHYQVRTVTTLGTESNPSATASATRTGDVTPPRMPYGLDAWDATDGVHLVWMPNTDDTDHYLVMRMQTFGAWEQVAVVRDAKYLDTSTPAGVRFGYTVRAVDAAGNVSPMPEPGYGTVYGKRLPVHEKPAAPASVTATADNGNVKVEWTASTSTDVAGYHVYRTTGTDPTTAYSVSPFITGTTFTNENVPAGKTWRYVVRAVSTHNQWSDFSPMAEVTVPCPVLTGPATPRITGGGRGADYAQLNWEVGACDQGATVSYNVYRSTSSSDVFTPEHRIATGVTALTYKDPGLARAYYYYVVTAVAADGTESAPQAVPFGISMMAP

SEQ ID NO: 484 - protein, 755 aa, Streptomyces Sp.
MRISLGTASRTGGAAVLSLATALAGLAFPATAHAAVTCPAGVWKAQYYANTTLSGTPKATVCDTAIAENYGYGDPSGVTLPSDHFGIRWTTTRNFGSGGPFDLSAAVQDGVRVYVDGHRKIDLWRNVSSTQRKTVRFTMPRGTHTLRVDFAAFTGTANISFSYKPVLGAAYDKTAPLAPVGVKSGYSASTLKSTLTWSRNHEMDLAGYRVYRRLAGTTGWSLRNATLITGTSFTEVPPATGATYEYALRAVDRSANASALSAVTSVVSADRTAPAAPTGLTATYDPSAGARLSWSPVSGASSYEVQRAVAPEGPFASVGTPLQSAALTDPSATAGTTYYYRVRARDNAGNASAYSATVQLDAPEAKPLPPTAVSANGWVDRNTVGWQYDGDASHRFHVYAAESAAGPWTRLTETPVTGPAYDDYAAPVREVRHYQVRTVTALGTESNPSATASATRTGDVTPPRMPYGLDAWDGTDGVHLVWTPNTDDTDHYLVMRSATFGAWEQIAVVREGTYLDTGTPAGVQFGYTVRAVDAAGNVSPLPEPGYGTVYGKRLPVYETPAAPASVTATADNGNVKVEWTASTSTDVAGYYVYRTTGTDPTSAYSVSPLITGTTFTNENVPAGKTWRYVVRAVSKHSRWSDFSPMAEVTVPCPVLTGPPTPRITGGGRGADYAQLSWEAGACDQGATVSYNVYRSTSSSDVFTPERRIATGVTALTYKDPGLARAYYYYVVTAVAADGTESAPQAQPFGISMMAP

SEQ ID NO: 485 - protein, 740 aa, Streptomyces Sp.
MLSLATALAGLAFPTTAHAAVNCSAGVWKAQYYANTTLSGTPKATVCDTAIAENYGSGDPSGVSLPSDYFGVRWTTTRNFGSGGPFDLSVAVQDGARVYVDGYRKIDLWRNVSSTQRKTVRLTMPRGTHTLRVDFAAFTGTANVSFSYKPVIGATYDKTAPLAPVGVKSSYSASTLKTTLTWSRNYEMDQAGYRVYRRIAGSSGWSLRNSTLITGTTFTDAPPATGAAYEYALRAVDRSGNVSALSAVTSVVSADRTAPAVPTGLTATYDPSAGARLSWSPVSGANSYEVQRAVAPEGPFASAGTPTQSAALTDPSAAVGTTYYYRVRAKDSAGNASAYSAPIQLDATEAKPLPPTAVSANGWVDRNGVGWRYDGDASHRFHVYAAEAAAGPWTRLTETPVTGPGYDDYAAPVGEVRHYQVRTVTTLGTESNPSATVSATRTGDVTPPRMPYGLDAWDATDGVHLVWTPNTDDTDHYLVMRKPTFGAWEQVAVVWDAKYLDTGTPAGVQFGYTVRAVDAAGNVSPMPEPGYGTVYGKRLPVHETPAAPASVTATADNGNVKVEWTASTSTDVDGYYVYRTTGTDPTSAYPVSPLITGTTFTNENVPAGKTWRYVVRAVSKHSRWSDFSPMAEVTVPCPVLTGPPTPRITGGGRGADYAQLNWEVGACDQGATVSYNVYRSTSSSDVFTPEHRIATGVTALTYKDPGLARAYYYYVVTAVAADGTESAPQAVPFGISMMAP

SEQ ID NO: 486 - protein, 387 aa, Bacillus Sp.
MKKIIWIPLVLILAAAVLCFFYFRTEEPAEVDRETLNDPDFLKNKEALLYFSTAADQDTFGGGKSYALFADKKGRLSSYQMKGLELGSAKVHDGSVLLEDKKGIYTVQNGLHTYKRTYQHTGDSAGYIERTKGFYTLYNSGYDKSGGSYRSELYRQIDGRWKQNVIPHYIRASGYFKDHLFALTPTDDEKGYHIQDIQADKEKLHTKSIATWTYKEGTSVESQLAADDGAVCFVTRGEKAEHIYQMVKVMRKSGTIKTYDIAAYKNDEQTIYDSMPFSFKKSFFMEQHSFYFVDGFGTVYRINPETGKSKKAFTLPASRMKADFKDLTHQNGKLYLFTYSYKKPAKIESFDLKTGKKLNDRTIPSLKDIITPKSHLKLYDVQVMDGF

SEQ ID NO: 487 - protein, 387 aa, Bacillus Sp.
MKKIIWIPLVFILASGVLCFFYFRTEEPAEVARDTLNDPDFLKDKEALLYFSTAADQDTFGGGKSYALFADKKGRLSSYQMKGLELGSAKVNDGSVLLEDKKGIYTVQNGLHIYKRAYQHTGDSAGYIERTKGFYTLYNSGYDKSGGSYRSELYRQIDGRWKQDVIPHYIRASGFFKDHLFALTPTDDEKGYHIQDIQADKEKLHTKSIATWTYKEGTSVESQLAADDGGVCFVTRGEKAEHIYQMVKVMRKSGAIKTYDIAAYKNDEQTIYDSMPFSFKKSFFMERRSFYFVDGFGNVYRINPETGKSKKAFTLPASRMKADFKDLTHQNEKLYLFTYSYKKTAKIESFDLKTGKKLNDRTIPSLQDIVTPKSHLKLYDVQVMGGF

SEQ ID NO: 488 - protein, 387 aa, Bacillus Sp.
MKKIIWIPLVIIAAAAVLCFFYFRTEDPAEVARDTLNDPDFLKDKEALLYFSTAADQDTFGGGKSYALFADEKGRLSSYHMKGLELGSAKVHDGSVLLEDKKGIYTVQDGLHTYKRAYQHTGDSAGYIERAKGFYTLYNSGYDKSGGSYRSELYRQIDGKWKQDVIPHYIRASGFFKDHLFALTPTDDEKGYHVQDIQADKEKLHTKSIATWTYKEGTSVESQLAADDSAVCFVTRGEKADHIYQMVKVMKNSDAIKTYDIAAYKNDEQTIYDSMPFSFKKSFFMEQRSFYFVDGFGNVYRINPETGKSKKAFKLSASRMKADFKELTHQNGKLYLFTYSYKKPAKIESFDLKTGKRLNDLTIPNLKDIVTPKSHLKLYDVQVMGGF

SEQ ID NO: 489 - protein, 394 aa, Bacillus Sp.
MKKIIWIPLVIIAAAAVLCFFYFRTEDPAEVARDTLNDPDFLKDKEALLYFSTAADQDTFGGGKSYALFADDKGRLSSYHMKGLELGSAKVHDGSVLLEDKKGIYTVQDGLHTYKRAYQHTGDSAGYIERAKGFYTLYNSGYDKSGGSYRSELYRQIDGKWKQDVIPHYIRASGFFKDHLFALTPTDDEKGYHIQDIQADKEKLHTNSIATWTYKEGTSVESQLAADDSAVCFVTRGEKADHIYQMVKVMKNSGAIKTYDIAAYKNDEQTIYDSMPFSFKKSFFMERRSFYFVDGFGNVYRINSETGKSKKAFKLPASRMKADFKELTHQNGKLYLFTYSYKKPAKIESFDLKTGKKLNDLTIPNLKNIVTPKSHLKLYDVQVMGGFEKEKQSS

SEQ ID NO: 490 - protein, 399 aa, Bacillus Sp.
MKKIIWIPLVIIAAAAVLCFFYFRTEDPAEVARDTLNDPDFLKDKEALLYFSTAADQDTFGGGKSYALFADEKGRISSYQMKGLELGSAKVHDGSVLLEDKKGIYTVQHGLHTYKRAYQHTGDSAGYIERAKGFYTLYNSGYDKSGGSYRSELYRQIDGKWKQDVIPHYIRASGFFKDHLFALTPTDDEKGYHVQDIQADKEKLHTKSIATWTYKDGTSVESQLAADDSAVCFVTRGEKADHIYQMVKVMRKSGAIKTYDIAAYKNDEQTIYDSMPFSFKKSFFMEQRSFYFVDGFGNVYRINSETGKSKKAFKLPASRMKADFKELTHQNGKLYLFTYSYKKPAKIESFDLKTGKKLNDLTIPNLKNIVTPKSHLKLYDVQVMGGFEKEKQSSNGLWE

SEQ ID NO: 491 - protein, 1226 aa, Streptomyces Sp.
MHRKRPRARTFLALLTGALLAGSSLSAVPAAAHPDEPAAEESFQQVTLAKGADAVGEPMSLAVLPDRRVLHTSRDGTLRITDAGGDTMVSGTLDVYSHDEEGLQGVGVDPDFAENRAIYLFYAPKLDTPAGDAPENGTAADFAPFDGYNRLSRFTLNEDGTLDKASEKKVLDVTTSRGTCCHVGGDIAFDADGNLYLSTGDDTNPFSSDGYTPIDERPDRNPAFDAQRSSGNTNDLRGKVLRIKVAEDGSYTIPEGNLFAPGTEKTRPEIYAMGFRNPFRISVDKKTGIVYVGDYGPDAGAASPTRGPAGQVEFARVTEAGNFGWPYCTGDNDPFIDYDFATKASGAAFDCDAPKNTSPHNTGLTDLPPAQPAWIPYDGGSLPEFGSGSESPMAGPVYRYDAALDSPVKFPEAYDGDFFAGEFGRKWIKRIEQGEDGTVSKINPFPWTGTQPMDMEFGPDGALYVLDYGLSWFGGDEHSALYRIENSTGGKSPIAEAAATKTSGKSPLKVTFSSAGTQDPDGDALTYAWDFGDGGTSTEANPSYTYKKNGTYTARLTVTDPTERTATASVRIVVGNTAPKVTLELPNDGHLFNFGDTIPFKVKVTDPEDGTIDCSKVVVRYILGHDSHGHPITSANGCEGTITAPADTEHDPNANIFGVIDAEYTDGGGGGQAALTTHDQAQLQPRHRQAEHFNNSSGIKIYDKAPANGGKTVGDIDNGDWISFKPYNLTGSKTLTARISSGGAGGFLEVRTGSANGNLLGSAPIPVTGGWETFQDIDVPLRSVPKQTTELFLVFKGGAGALFDLDDFQLSTAVPGKTEKRVLVFSKTGGFRHDSIPAGIAALKELGKTTGITVDATETAGQFTTNNLARYDAVVFLSTTGDVLNADQQKAFENYVATGGGYMGVHAAADTEYDWAFYGGLVGAYFDSHPQIQPATVRVEDHDHPSTAHLDDEWQRTDEWYNYRTNPRDQARVLATLDETTYQGGNMKGDHPIAWCQTYEGGRSFYTGGGHTKESYADDAFRQHLLGGLRYAAGQVKADCKPKTGYRDLFNGKTLEGWKQAGPGKFNVVDGELRTEGGMGLLWYQAKELKSYSLKLDWKMDGDDNSGVFVGFPASDDPWSAVNKGYEIQIDATDSADRTTGAVYGFKSADIKARDQVLRPPGQWNNYEIKVQGERLQIFLNGVKINDFTNTDPERSLKNGYIGLQNHGADDQVSFRDIQLKELPAA

SEQ ID NO: 492 - protein, 1243 aa, Streptomyces Sp.
MHRKRTRARTLLALLTGAMLAAASLSAVPATAADSGAAAVAHDPGHDDPGHDDPAAAEDFQQVTLAKGADETGEPMSLAVLPDRSVLHTSRDGTLRITDAGGDTTIAGKLDVYSHDEEGLQGVGVDPGFAENRAIYLYYAPKLDTPAGDAPENGTAADFAPFDGINRLSRFTLNEDGTLNAASEKKVLDVAASRGTCCHVGGDIDFDADGNLYLSTGDDTNPFASDGYTPIDERTDRNPAFDAQRSAGNTNDLRGKLLRIKVAEDGSYTIPEGNLFAPGTEKTRPEIYAMGFRNPFRISVDEKTGIVYVGDYGPDAGAASPTRGPSGTVEFARVTEAGNFGWPYCVGNNEPFIDYDFATKQSGEAFDCSAPKNTSRNNTGLTDLPAAKPAWIPYDGGSVPEFGTGSESPMAGPVYRYDADLDSPVKFPEAYDGDFFAGEFGRKWIKRIEQGEDGTVEKINPFPWTGTQIMDMDFGPDGALYVLDYGLSWFGGDEFSALYRIENATGGKSPIAEATASKTSGKAPLKVAFSSAGTQDPDGDELSYQWDFGDGSTSTGANPTHTYKKNGTYSARLTVTDPTERTGTASVRVVVGNTAPTVTLELPADGTLFDFGDTLPFKVKVSDPEDGTIDCSKVTVRYVLGHDNHGHPITSANGCEGTITAPADAEHDPNANIFGVIDAEYTDGGGGGQAALTSHDQAQLQPRHRQAEHFTGSSGVNVIEKEAANGGKTVGDIDNGDWISFKPYNLTGSKTLTARVSSGGSGGFLEVRTGSAKGTLLGSAPIPVTGGWETFQDVDVPLRSVPKKTTELFLVFKGGSGALFDLDDFEISTKAPGKTEKRVLVFSKTAGFRHDSISAGVAALKELGKTTGITVDATETAAQFTTNNLARYDAVVFLSTTGDVLDAEQQKAFENYVATGGGYMGVHAAADTEYDWAFYGGLVGAYFDSHPAIQQATVRVEDKDHPSTAHLDDEWQRTDEWYNYRTNPREKARVLATLDETTYQGGTMKGDHPIAWCQTYGGGRSFYTGGGHTKESYEDAAFRRHLLGGLRYAAGQVKADCEPRTGYRDIFNGKTLEGWKQAGPGKFNVVDGELRSEGGMGLLWYQAKELKSYSLKLDWKMEGDDNSGVFVGFPASDDPWSAVNKGYEVQIDATDAPDRTTGAVYGFKSADVKARDRVLRPPGQWNAYEIKVQGERLQVFLNGVKINDFTNTDPARSLKDGYIGLQNHGADDQVSFRDIQLKELPSS

SEQ ID NO: 493 - protein, 1225 aa, Streptomyces Sp.
MPRRRHRSRSLLALVAGALIAGTISAVPAAAHPDDPHPTDDMFQQVALAKGADEVGEPMSLAVLPDRQVLHTSRDGTLRITDAAGDTKVAGKLDVYTHDEEGLQGVGIDPDFAENRAIYLYYSPVLDTPAGDAPETGTAADFAPFDGYNRLSRFTLKEDGTLDKASEKKVLDIETNRGLCCHVGGDIAFDADGNLYLSTGDDTNPFASDGYTPIDERPNRNPAFDARRTSGNTNDLRGKVLRIKVADDGSYTIPEGNLFAPGTAKTRPEIYGMGFRNPFRINVDQKTGIVYVGEYGPDAGAASETRGPAGQVEFARMTEAGNFGWPYCTGDNDAYRDYDFATGTSGPAFDCAAPKNDSPHNTGLTDLPPSQAAWIPYNGNSVPEFGDGSESPMGGPVYNFDPDLDSPAKFPEEYDGDFFAGEFGREWIKRIEKDADGTVSAIHDFPWTGTQVMDMEFGPDGALYVLDYGRAWFGGDENSAVYRIENIANGRAPVAKATSSKTSGKAPLRANFSSAGTADPDGDEITYAWDFGDGGKSTEPNPSYVYKKNGTYTATLTATDPDGNTGNSSVRVVVGNTAPKVTLTVPADGALFKFGDKLPFKVTVTDPEDGPIDCSKVTVNYILGHDSHGHPITSAKGCEGTITAPADGEHDPNADIFGVIDAEYTDGGGGGQAALTTHDQVQLQPRHRQAEHFTNQSGIKTYDKASANGGKTVGDIDNNDWISFKPYNLTGSKTLTARVSSGGSGGFLEVRTGSATGTLLGSAPIPVTGSWDTFQDIDVPLRSVPKATTELFLVFKGGQGALYDLDDFEISEQAAGKTEKRVLVFSKTAGFRHDAIPEGIAALKELGKSSNITIDATETAAQFTTNNLARYDAVVFLSTTGDVLNPEQQKAFEYYISTGGAYMGVHAASDTEYDWPYYGKLVGAYFSGHPQIQQATVRVEDHEHPSTGHLDDEWQRTDEWYNYRDNPRSNVKVLATLDETTYQGGTMKGDHPIAWCQTYEGGRSFYTGGGHTKASYAEPAFREHLLGGLRYAAGQVKANCKPNTGYRDIFNGKTLDGWKQAGPGKFNVGGGELHTEGGMGMLWYQAKELGSYSLKMDWKMDGDDNSGVFIGFPASDDPWSAVNNGYEIQIDATDAADRTTGAIYGFKSANIKARDQVLRPPGQWNSYEIKVQGERVQVILNGVKINDFTNTDPVRSLKDGYIGLQNHGADDQVAFRDIQLKELAS

SEQ ID NO: 494 - protein, 1238 aa, Streptomyces Sp.
MHTTRSGSRTRLRIRKSLALFTGGLLAAATLSLSAASGTAAAHEEPAPAPAAEDFQQVTLAKGAAETGEPMSLAVLPDRSVLHTSRSGELRITDSAGNTRISGVIPVYSHDEEGLQGIGVDPDFSENRAIYLYYAPPLDTPAGDAPETGTAADFAPFDGVNRLSRFVLNEDGTLDLGSEKKVLDVKTSRGMCCHVGGDIDFDADGNLYLSTGDDTNPFASDGFTPIDERPDRNPAFDARRSAGNSNDLRGKILRIKVADDGSYTVPDGNLFAPGTDRTRPEIYAMGFRNPFRFSVDKATGIVYVGDYGPDAGAADPKRGPAGQVEFARVTKAGNFGWPYCTGANDPYIDYDFATKTSGAAFDCAAPKNTSPHNTGLVDLPPAQAAWIPYDGGSVPEFGTGSESPMGGPVYHYDADLDSPVKFPEAYDGDFFAGEFGRQWIKRIEQDADGKVQSINDIPWSGTQIMDMAFGPDGALYVLDYGLSWFGGDENSALYRIENATGGRSPIAEATSDKTSGTAPLKVRFSSAGTTDGDGDTLTYAWDFGDGGTSTAPNPTYTYKKNGTYTATVTATDPSGRTGSASVHVTVGNTAPTVKLELPGDGQLFTFGDAIPFKVTVTDPEDGTIDCSKVEVRFVLGHDSHGHPITSEHGCTGTIKTEMDGGHDPNANIFGVIDASYTDGGGGGQAALTGHDQSQLQPRHRQAEHFTDSSGIKTYDKANAEGGKTVGDIDNDDWISFKPYILGDSTKLTARISSGGAGGFLEVRTGSPTGKILGSAPVPVTGGWETFQDIDVPLRGVPKQATELFLVFKGGEGALYDIDDFELSNTPPDRTAKRVLVFSKTAGFRHDAIPEGIAALKELGKDSNITVDATEEAGQFTTANLARYDAVAFMSTTGDVLNADQQKAFENYIRTGGGYLGVHAAADTEYDWSFYGGLVGAYFSSHPAVQPVTVRVEDHKHPATAHLGDAWQRTDELYNYRTNPRDKVKVLATLDETTYTGGTMKGDHPITWCQTYEGGRSFYTGLGHTKESYADADFRKLLLGGMRYAAGQVKGDCKPSTGYRSIFNGKTLEGWKQAGPGTFDVVDGELRSEGGMGLLTHQAKELTSYSLKLDWKLAGDDNSGVFVGFPESDDPWSAVDNGYEVQIDASDAVDRTTGSVYTFKAADIKARDRVLRPPGQWNSYEIKVRGERLQVFLNGVKINDFTNTDPVRSLKDGYIGLQNHGADDQVSFRNIQLKELPTT

SEQ ID NO: 495 - protein, 1238 aa, Streptomyces Sp.
MHRTRSRTRSTLRVRKSLALLAGALLAAATLALGATPGTAAAHEVPAPAPAAEDFQQVTLAKGVAETGEPMTLAVLPDRSVLHTARGGELWLTDNGGDTTLAGTIPVYSHDEEGLQGVGVDPDFSENRAVYLYYAPPLDTPAGDAPENGTAAEFAKFDGVNRLSRFVLKEDGTLDMASEKKVLDIPTSRGMCCHVGGDIDFDAQGNLYMSTGDDSNPFASDGYAPIDDRPDRNPAFDARRSAGNTNDLRGKIIRIKVAEDGTYTVPDGNLFAPGTDKTRPEIYAMGFRNPFRFTVDKTTGILYVGDYGPDAGAADPKRGPGGQVEFARVTAPGNFGWPYCTGDNDPFVEYDFATKTSGEAFDCAAPKNTSRYNTGLVDLPPAQPAWIPYDNGSVPEFGTGSESPMGGPVYHYDADLDSPVKFPEEYDGDFFAGEFGRAWIKRIEQDADGTVQSINDVPWSGTQIMDMAFGPDGALYVLDYGTGYFGGDENSALYRIENATGGRSPIAEATANKTSGTAPLKVAFSSAGTTDGDGDALTYNWDFGDGGTSSAANPTYTYKKNGTYTATVTATDPTGRTGSANVHVTVGNTAPVVNLELPGDGQLFSFGDEIPFKVTVTDPEDSTIDCSKIEVRFILGHDAHGHPITSAHGCEGTIKTEMDGGHDPNANIFGVIDASYTDGGGGGQAALSGHDQSQLQPRHRQAEHFTDSSGIKTYDKANAEGGKTVGDIENDDWISFKPYMLGDSTKLTARIASGGAGGFLEVRSGSADGKILGSAPVPVTGGWEVFQDIDVPLRGVPTKATELFLVFKGGDGALYDLDDFELSNSAPDKTAKRVLVFSKTGGFRHDAIPEGIAALKELGKDSNITVDATEEAGQFTTSNLARYDAVVFMSTTGDVLNADQQKAFENFVTTGGGYVGVHAAADTEYEWPFYGGLVGAYFDSHPAIQPVTVRVEDHKNPATAHLSEAWDRTDELYNYRTNPRGKVKVLATLDETTYTGGNMKGDHPITWCQSYQGGRSFYTGLGHTKESYADPDFRKVLTGGLRYAAGQVKADCKPDTGYRPIFNGKTLEGWKQAGPGKFDVVDGELRSEGGMGLLTYQAKELKSYSLKLDWKLAGDDNSGVFVGFPESDDPWSAVDNGYEVQIDATDAPDRTTGSVYTFKSANTKARDQVLRPPGQWNSYEIKVQGERLQILLNGVKINDFTNTDPARSLKDGYIGLQNHGADDQVSFRNIQLKELPSA

SEQ ID NO: 496 - DNA, 746 bp, Artificial Sequence
  Optimized for E.coli
ccatggcgccggcggcggcgaccgagccggcgccgttcagctgcctggatccgagcggtgaagcgctgtggagcggtccgcagtgcgatggtgtgattgttcgtgagctgggtaccgaagcggtggcgattctgctggacggccgtcgtatcgacttcgcggatgaggcggaactgcgtgcggatgattgcgcggtgcgtccggcggttaccctgccggcgagcacctttgagaacctgccgaaaggtccggatccgctgtatgcggcggttgaccgtcgtgtggatgttccgcgtatcattccggaaccgcagtggcgtaagaactgccacccgctgtttcgtagcgacggtcgtgatccgagcgtgattttcgaggaaggttttggcccgaaagacaccgttaacggccaatacgatatcaccagctatgtgctgcagaaccaaccgagcccgttcgttagcaccacctacgacccggagctgtataagaaatggaagaaagtgccgtgggactactttatcgatgcgccgggtggcattgatgttaacgcgaccatcggtgaccagcaccaatatgcggatcaggttgaggtggcgttcccgggtggcgtggaccgtcactttatccgtcgtgcgtgcccggttgatcgtgcgaccgcgagcctggtggaagcgggttgcgttgacaacccgaactatcaaccgtggctgcaccaccaccaccaccaccactaataagaattc

SEQ ID NO: 497 - DNA, 7400 bp, Artificial Sequence
  Optimized for E.coli
ccatgggtctgattgcggcggtggttcaagtgccggttattgcggcggcggcggatggcgagttcaagctgccgagcgttcaacacattgaaagcgtgccgctgagccgtgttaccggtgatcgtccggacaccggtgcggcgcagccgccgaccgctccgccggcgagcgcgtggccgaagccgggcaaaaccgagattgacctgccggctgtgagcgcgcaacagccgagcagccaagcgaaggcgccgggtctgccgctgaccgtgagcagcgttggtccgaccccggcggcgggtgaaccgagcaaagtgcgtgttggtctgagcgatcgtgcggcggcggcgaccgttggcctggacggtctgctggtgaacctggagccggttgcgggtagcgcggcgccggacaaggcgcgtgttcagctggattacaaagcgttccgtgaaagctttggcgcggactggggtagccgtctgacctttgttcagctgccggcgtgcgcgctgaccaccccggatcagccgcaatgccgtagcgcgaccccgctggcggcgagcaacgacaccaaagcgggtaccctgaccgcggaagtggcggttagcgcgccggcgggtcaagttagcgcggatggtcaagcgagcagcggtggcaccgtgaaagcgagcttcacccaagcgagcgaggcgagcgcggcggcggcgaccgtgctggcggcgaccgcgggcgcgagcggtccggaaggcgactacaaagcgaccagcctgagcccgagcagcacctggagcgtgaccggtaacaccggcagctttacctggagctatccgatccaagtgccgccggttccgggtggcatggcgccgaaaatcgcgctgggttacaccagcgcggcgattgatggccgtaccgcgagcaccaacaaccaaagcagctggattggcgatggttgggactataacccgggtttcatcgaacgtaactataccccgtgcgttggtgacaccggtccgggtagcaacgcgccggcgaccagcggtgacctgtgctggaaaagcgataacgcgaccatcagcctgaacggcaacgcgagcgcgctggttcgtgacgatgcgagcggtacctggaagctgagcaacgacgatggtagccgtgtggagaaactgaacggcaacaccaccgataccgcgaacggtgacaccgataacgaatattggaaggtgaccaccaccgacggtacccagtacctgttcggcaagaaccgtctgccgggctggaccaccggtaaaccggagaccggtagcgcgctgaccgtgccggttttcggtaaccagccgggtgaaccgggttatgcgccggcgtttaaagatagcagccgtgatcgtgcgtggcgttggcagctggattacgtggttgacccgcacggcaacgcgattgcgtacttttatggtcaagagaagaacgcgtatgcgaaaaacattggtgcggcgaccggtaccccgaaagcggatgcgctgtacacccgtgcggtgaccctgaaccgtatcgaatatggccaccgtgcgggtcaggtgtacaacaccccgccggcgggtaaagttacctttagcaccgcggaccgttgcgtggcggcggattgcagctttaccaaggcgaacgcgggcaactggtatgataccccggttgaccagagctgcgacaaagatcaagactgccgtaacggtgcgccgaccttctggagcaagaaacgtgtgaccggcattagcacccaggcgctgcaaagcaacggtagctaccgtgatatcgacgcgtggagcctggatcaggactttccggcgaccggtgacagcggtggccgtgcgctgtggctgaagaccattacccgtaccgcgaaagcgggcgcggcggcgcagaccctgcaaccggttaccttcggtggcgacctgcgtccgaaccgtgtggatagcgcggagggtcgtccgccgatgaaccgttatcgtgttaaccgtatcaccagcgaaaccggcagcaacaccgatatcaagtacaccgatattgattgcgtggcgggtgcgctgccggcgccggacagcaacacccgtcgttgctatccgtcctggtggaccccggagggtgcggtggatccggttctggactggttccacaagtacctggtggacaccgttaccgagcacgatatggttgcgggcagcggtagcccggacaaagtgaccggttacgaatatctggacggcgcggcgtggcgtcgtgataacagcgagttcaccccggacaaggaacgtacctggaacgattttcgtggctatcagcgtgtgcgtacccgtgttggtgcgagcgataaaagcctggcggaaaccgtttactttcgtggtatggatggcgacaccctggcgaacggtcagccgcgtccggcgagcccgctgcaaggcgtgaaggatagcaacgagctggcgggttacgtgcgtgaaagcaccgtttatgataaggacggtggcaaaccgctgaccagcaccgcgagcaccccgtgggttcgtggtaccgcgagccgtgcgaccaaggcgctgccgagccaagatggcaagccgaccgcgaccccgccgggcgagagcggtcgtccgcaagtggcggcgctgccgccgctgaccgcggcgatggtgcgtaccgagagcgaaaccaccaaagcgttccaaccggatggtggcaccgcgcgtaccacccgtctgagccgtacctttgacgattacggtcaaattcgtaccgtgagcgatgagggtgacaccaacatcagcggcgatgaacagtgcacccgtaccgcgtatgttacccaagacaccgcgaactggctgatcgcgtacccgcagagcgtgcaaattaccagcaccctgtgcagcaccaacgcgaccgcggcgaccgttaccagcgagacccgtaccgcgtatgatggtcgtccggtgggtaccgcgccggaaccgggcaagggttatgcgaccaccgttcaggcgctggatcgttacgacggtgcgaccccgcactatctgacggcgaccaccaccgcgtacgaccaatatggtcgtgtgatcagcgttaaaggcgcgaacaacgcggagaccaccaccagctacaccccggcgggtggcagccagccgaccctggtgcaaagcaccaacgcgaagaaattcaccaccaccaccgcgtatgatggtctgcgtgcgctgccggtgaaggttatcgacgcgaacaaccgtaccattcacgttgattatgatgcgatgggccgtaccaccgcggtgtggaacgcgggtcgtgataaaagcgcgagcccgagcgcgacctacacctataccattgaaccgggtcgtcagccggcggttaccacccgtaccctgctggaaggtggcgattaccacaccagcatcgcgctgtatgacggtctgctgcgtccgcgtcaggtgcaagatgaagcgcacggtggcagcaccgcgcacaacggtggccgtaacatcaccgatagcttttacgacagccacggtcgtgcgtaccgtgcgaacgcggcgtatcatgcggatggtgcgccggaggcggcgctgtggattggtctggacaacaaagttccgagccagaccgagaccgagttcgatggcctggaccgtccgaccgcgagcatctttaagagcctgaacgtggaaaaatggcgtaccgttacccgttatggtctgaactgggtggcgaccaccccgccggatgcgggtaccagcaccctgaccgttgcggatgcgcacggccgtccgagcgaggtgcgccactacaagaccggtagcccggattatgatgcgccggcgagcgcgtatgaaaccctgaaatacacctatgatagcgcgggcaagctggcgaaactggttgacccggcgggtaacgcgtggacctgggagtatgatctgctgggtcgtcagaccaagaccgtggatccggacaaaggcaccaccaccagcgcgtacaacgcggatggtaccctggcgaccgttaccgatgcgcgtggtcgtaccctggcgtacacctatgatgtgctgggccgtcgtaccggcatgttcgacggcagcaccagcggtaccaagctggcggagtgggcgtttgatagcctgccgggtagcaacggtctggcgaccggtagcacccgtttcgaaaacggcaaagcgtacatcaccggtattaccggttttgatggtgcggcgcgtccgaccggtaccaccgttaccattccggacagcgaaggtctgctggcgggtacctacaccgcggcgcagacctataccccgaacaccggtctggttgacaacaccacctacccggcgggtggcggtctgccgcaagaaaccgtgcgtcgtaactacaccccgctgggtctgccgaccaccgtgagcggcggtagccgtgtttacagcctgggtaacacctatagcccgctgggccagctgcagcaaagcgttaccggcgatattggtagccgtgcggtgcaaacctacgactatgagaacgcgacccagcgcctggcggtggttcaaaccgaccgtgagcgtagcggtccgcagaccctggaaaagaaaacctacacctataacccggtgggtaacatcacccgtgttcgtgatgcgcgtgacaacgcggcggttaccgacacccagtgctacacctatgatttcgcgcaacgtctgaccaacgcgtggagcgcgaccgatgattgcgtggcgaaaccgaccccgaccaccgacccgtatgtgggcggtgttgatccgtactggaccagctacacctatgatgcggcgggtaaccgtacccaagcgaccgaccgtacctttggtgcggcgccgggtccgctgatggataccaccaaagtgaccagcgttgcgattgcgggtgatggtcaaaccaccgcggtggcgattgcggatggtcaagttcacattgcgcagcaacgtaccgacggtacctgggcgaactttgagaacctgcaccgtacccaagcgggtagcctgccggcgccggtggattatgttgcggcggcgtgggcggacaacaccctgcaaatcatggcggttgcgggcggtcgtatttggcacaccctgcgtggcgcggatggtcgttggggcgcgtggggtgacgtgaccagcgtggttggtagcattgcgaacccgagccagctgagcctgagcgcgaccgcgagcggcctggaagtgctggcgctgagcgatggtgttctgaagcacaccctgcgtaaaccggacggtaactggagcacctggggcaacgtttatggtgaaaccggtagcctgaccggtgcgacccgtgtgaccagcgcggcgaccggcaccggtctggaagtgattgttaccgcgggtgataagctgtggcacaccgttcgtttcccgggcggtacctggcagaaatggggcgacgtgtacagcgcgaccggtaccctgggtagcccgaccggtatcaccgcgaccgcgaccggtgcgggtctggaagtggcggcgatcgttggcggtagcatttggcacaccgttcgtaagccggatggcaattggagcacctggggtaacgtgagccaggttctgggtcgtctggatcaaccgaccagcgcggcggtggttagcagcggcggtgacctgaagctgatcaccattgcggcgggcagcctgaactacaccaaacgtgcgtatgcgaccggtagctggctgccgtgggcgcagctgacccaaaccccggaaaacccgccgagcgatcagattcagcgtaccagcacctatccggcgccgggcggtacccgtccgcatgcgctgagccgtgtggacatcaccggcattggtgcgcgtaccgataccttcacctacgacgaggcgggtaacaccgtgcgtcgtgttaccgcggatggcgaccagaccctggattgggacatcgagggtcacctggcgaagagcaccaccgcgggtaaaagcaccacctttctgtatgacgcgaacggcaaccgtctgctgcgtcgtgagccggatgcggttaccctgtacctggatggtcaggaactgaagctggaccgtgcggcgaacaaagtgaccggtacccgttatatcaccgcgggcccggtgaccattgttaaggcgagcgatggcagcctgaactacctgattaacgaccagcaaggtagcgcgcaactggcgatcagcgcggataacctggactatacccgtggcgacaccaccccgtttggtaccccgcgtggtcgtaaaccggcgagctggccgaccgagcgtggttttgtgggcggtaccaacgatgcgaccaccggtctgacccacctgggtgcgcgtgattacgacgcggcgaacggccgtttcattagcgtggacccggttctggatccgaccgacccgcagcaaatcaacggttacacctatagcaacaacaacccggttaacctgagcgacccgagcggtctgcgtccggaaggtacctgcggcggttttggtgcgtgccagaccccgaccggtgaaaaagtgcaagaagtttggaccagcgaccacggtgtgtggaccgataccattaccaagacccgtccgccgtatcagccgccggcgcaaaacaccagcagcggcatcccgggtctgaagaaaccggcgccgcagaccgcgcaaccggacgatgcgtgcggtagcaaggcggtgtgcgcgatggcggacaaagttgacgatgcgatgcgtctgtgcgcggagatcggctgcggtgtgtacagcgttaccaactatccgcgtaacaacgatagcagccacgacgttctgcgtgcgtggctgctgaacgcgtgggataacccggacgtggttaacttcggcgcgggtgatccgctgctgatggacctggcgaagaccgatgaggtgcaggttctgatggaaatgctgctgaccaactataaggagaaaggcgcgaaagcgattggcgagccgctgcgtaaccaatacgaagataacggtccgctgggtaccgcgtggctgggtatcccggcggatgttctgggtagcctgaccaacggtgcgattggtgcggacgaagcgaaagcggttattggtagcttcgtggttcacggcaccatcgatagcgtgcagagcgcgcgtgacggttatcaagtggttaacatgcactttaccgtggttaacaactggaactggaacagcgcgaccaagatgctgccggcggattggtatccgaccattccgaccgcgagcggcgttggttggaccccgggcaaaccgatcgacggtcactttgaatggggcttccgtagctttgtgggtccgagcggcggtcaccaccaccaccaccactaataagaattc

SEQ ID NO: 498 - DNA, 2135 bp, Artificial Sequence
  Optimized for E.coli
ccatggcgcgtgcggcgggtccggcgaccgtgccggagcaggaaagcatcgaagcgcaaattgcgcgtgcggcggcgagcggtaagaaacaggtggacatcgagccgggtgaataccgtcgtggcagcgttctggacctgagcggtctggatggcttcaccattaacgcgaagggtgtgaccgtggttcagacccgtctggtgcaagcggttcgtaccggtaccagcaacaacctgaccgttaccggcctgaccatcaactacgatccgctgccgtttacccaaggtcgtgtgattggtctgggcaagaccagcgacggcaaaccgtggatggacgttcgtatcgatgcgggttatccgcgtccggataaaattccgagccgtgtgagcgtttacgatccggcgctgcgtctgtggcgtagccaggcgtataacatcccggtgacctggcaagatcgtaccgcgggtgtggttcgtagcatgggtggcgcgtgggcggcgggtaccggtgatattgttgcgtttgcgggcgaggcggaaagcggtccggacatcgcgattggtgtgggtggcgcgaacaacacctttaaggatgttaccctgcacaccgcgccgggtttcggctttcagaaccgtgcgggcgagggcaacacccacctggacaactttcgtgtggttccgggtccgccgccgccgggtggtaccgaaaaaccgatcctgaccaccacctgggacgcgatgggttttggctgggtgaagaaaggtccgaccgttgagaacagcaccgtggttggtgcgggcgacgatagcatgagcgtgcagggtttcggcaccgcgaaggttctgaaagcggatggtgataccctgtgggcggcgttcgcggatggttttcgtaacgcgctgccgggcgatcgtctgcagcaatggaccgacggtccgaccgcgagcatccgtagcattgcgccggaaaaagacccggcgatcaaagcgctggcgggtgcgaaggcggatttcacctataaactgaccctggaccgtccgagcccgtggaacgcgggtaccgacatcaccaacctggatcgtattggtagcggcttcgtgtttcgtaacaaccgtattgatagcagcggtcgtggctttctggtgaaggcgcgtgacggtgttatcgagaacaactggatgcgtggcgtgaacagcattagcgttaccccggaaaacaccagcgatgcgaacgcgaacagcggtggcaacctggtgatccgtggtaacacctttaccggtaccctggttagcgcgccgggtggctgggatagctgccaggttggtgcggttagctttgacccgggtagcgcgagccgtccgctgtacccggacatcaccattgaggataacgtttttcaagacatccgtggtaccggcctgaacctgggtagcgcgaagaacgtgaccgttcgtaacaacttctttcagcgtagccaccaagcgacctacccggcgaccaagaaccgttgcggcattccgaaaagcagcgtggtttatgtgagcaacagcaccggtgttacctttgaaggcaacaccatcgatcgtattggtccgtatagcgtgcagcaagtgaccgttgacgatcgtaaaccgagcggtatcagcggtctgccgggtggcgtgaaggttctgaacccgtacctgccggttaaagcggcgagcacctataccattagcaaccgtgacagccgtctgctgctggcgccggcgggtggcagcaccgatgcgggtgcgggcgtggaacagcaaagcgcggcggatggtagcgcgcagcgttggcgtctgagcccggcgggtaacaacaacaccgtgcgtatccaaaacgcggttagcggtctgttcctgaccggtggcagcgatagcgcggttacccagcaaccgcgtagcgacgatcagagccaacgttggcgtctgctggacaccggtaacggcaccgcgaagattagcaacgtggcgaccggtaaagttctgggcgcgaccgacagcgcgccgggtgcgccggcgggccagtggccggttagcggtgcgctggatcaagcgtggaaatttaccgacgttagcccgcaccaccaccaccaccactaataagaattc

SEQ ID NO: 499 - DNA, 2135 bp, Artificial Sequence; identical to SEQ ID NO: 498
  Optimized for E.coli

SEQ ID NO: 500 - DNA, 3086 bp, Artificial Sequence
  Optimized for E.coli
ccatggcgagcaaaaacatcagccagctggttagcagcgatggtaacagcagcgcgccggcgaccagcgcgccgggttgctttgttcatgatggcgagagcatcgaaggttttccgaacaagtggggcaaaattttcagcgatccgcacaagggtaaccaggtggagttctactttaccggcgatcaatatttcagcaccgtggcgaaagcgatcctggacgcgaaggaaaccgtttttattaccggttggcaggtgaacttcgacgttgagctgaccagcgaaatgaccctgtaccagtgcctggagaccgcgatcgataagaacccgaaactgcaaatttatgtgatgccgtggctgagcccgaaagtgggcgttgacaccggtgattttgaaaccatgctggcggttttccagctgaacagcggtctgccggcgccggcgcgtgcgttcgcgctgccggcgattgcgcagagcgaccaaaaaggtggcctgggcattggttttagccaccaccaaaaactggtggtgatcgataacaagaaagcgttcgtgggtggcattgacctggcgtacggccgtcgtgataacggtcgtttcagcctgagccacgacggccgtgttggtaacgagctgtacaacacctgcatcccggcggtgcaccagatgaccaaggttgagcagggtaaatatctgacccgtgcggaactgctggcggcgtgcttcgatggcaagtttggtaaaattagcacctttgcgaccagcgcgccggcggagccgattgcgaagctgcaggacaaactgcaagttattagcgacgcgggtgcggatctgaccaagcgtatcagcgataaatggaacagcagcaagctgctgccggaatttgtgggcaaactggcggacatgccggttgatgcggcgcagaccgcgagccgttgggcgttcagccgtctggatgcgagcgtggttgacaagattgatggtctgcgtacgatgggtaccgcgcatgcgaccgatgcggagaccgcgctggttgcgtggctgaaccacaccagcctggaacgtctgccggcgagcctgcgtgcgaccaccgttgagctgatcgaaaccttcaccattgcgaccctgagctacctgagcaacatggcgaacacccgtagcgcgcgttatgagaacctgcgtaacctgcgtaaaatcgtgccggcgagcggcaaggttattagcaccagccagccgcgtatgccgtggcacgatgtgcactgcagcattgttggtccgagcgttagcgacctgagccgtaactttattcagcgttggaacggtctggcggttcgttacgaacgtagccacggccgtattgtgcgtccgcatgcgctgcgtcaagtttttgcgagcctgggtctgccgagcattgcgccggtgaaactgccgcgtattgcgccggcggcgctgccgagcacccaggcgcgtccgggcaaggcgtgggtgcaagttctgcgtagcgcgccggttcgtctgctggcggatgagaaagcgggtaccgcgcacaagagcgatagcgcgccgagcccgaccattgcggaaaacaactgcctgaaagcgatgctgaccgcgattagcggtgcgcagaagttcatctatattgagggccagttctttcaaagcgcgcacggtggcaaaaacaccgagatggaaagcatcgcgggtccgatgcaaaccctgctggacgtgaccaaaacccgtggctacaagaaatatgcggaacagctgggcattaagggtgtgccgccgcaaaagatgctggcgaaactgcgttggagccagatcgacgatgttaaagcggatattcaaggtggcggtgcggactttatcaacgatctgaacgcgatcattgcgaaccatgcgagcattgaagcgacccgtgcgctgggtccggcggacaaggcgattgcgaacccgattggtgaagcgctggcgctgcgtattgaaggtgcgattcaggatggtctgccgttccacgtttacctgatcgtgccggttcacccggaaggtaccctgaacaccctgaacattatgacccagctgcacctgaccatgcaaagcctggtgttcggccgttttagcctggttaaccgtatccgtcgtgcgctgctggtgcgtgacctgcgtatgagcaagaaaatgaccctgaccgatgcgaagaaagtggttgcgggttacagcctgctgcgtctggagcaggaagttcaagacgagtggagcgatcacctgaccctgctgaacctgcgtagctggcaaatgctgggcggtcgtccggtgaccgaacaaatctatgttcacagcaaactgctggttgcggacgatcgtgttgcgatcctgggtagcgcgaacattaacgaccgtagcctgctgggcgaccgtgatagcgagctggcggtggttatccgtgacgatgcgcagattgacgtgaagctgaacggtatcgatagcgaaccggttagcgcgagcgttcacaaactgcgtaccggcctgtggcgtaagctgtttggtatgaccgatggtgcgaccccggcgaccgagctgagcaccgtgattggtaccccggcggcggagggtgcgtggctggcgattcaaaagaccgcgcgtgttaacgcggaggcgtacagcaaagcgttcccgtttctggcgaacgtgaagggtgaaccgagcagcatctggccggtttggaaccgtgaccagctgtgcctgaaattccaaatgccgtttgatgagcgtttctggcgtaaggcggaagtgcgtgacccgagctttagctggaacgcggagcagcgtgcgccggaaagcgcgccggtgggcgttaaaggtttcattgtggcgctgccggttacctggaccgcgggcgaggacaacattagcggtatgaacctgaccctgctggcggagcacaaccaggaaccggcgaccctggaccaaagcgaaccgagcggcaacggtctgcgttatgcgaagggtaacagcctggatcaagcgaacgagggcgaaagcaccagcgcggttcaccaccaccaccaccactaataagaattc

SEQ ID NO: 501 - DNA, 2126 bp, Artificial Sequence
  Optimized for E.coli
ccatggagaccgcgaccgcgggtcaggacagcggtgcgctgagcgcgcgtgtggcgccgacccaggaagatatccaactgggtagctggatgagccagctgggtagcaccatcggcgaccgtccgctgaaccaaattgttatgccgggtagccatgatgcgggtagcgcgggcattaccaagaacagcggcatgtgcgatgcgggtgataccgtggacaccgcgcgtaaatggccggagctggcgagcagcatgagccgtacccagagcggtagcctggttgagcaactggaagcgggcagccgttacctggatctgcgtctgtgcaagcagggtgacaaatggtacagctatcacggtggcccgctgggccgtcagttctttgacagcctgggtggcaaccaaggtattgttccgggtgaagcgcgtgaactggcggattggattaaccgtcacccgaaggagatcgtgattctgcgtgttaaaaccaccggtccggcggcgaccctgaaggaagacagccgtgcggcgattgcgcgtctgggtggcctggttggtggcggtggcctggataacccggcgattgcggacggtagcctgaagccgaccagcacctacaacgagttcatggcggcgggcaaacacgtggttgtggttgacgataccgacagcaccacctatccgtgggcgtggcagcaaccgaacgtgcaggattaccgtggtagctatgtgggcgttagcagcaagtgggacgatattctgaaagcggcgctggacccggcgctggagcaaaagacctatgatgcggtgctgcgtcgtggtgacgaagttctgggcaaaaccccggagccgggtagcgaaaagaaactgttcgttcagcaagcgatgatcgacccgagcaacagcattccgagcgcggcggtgatccagattctggagaagctgaaactggttagcgaatggaaggcggataactttctgatcagcatggagaacgaactgaaccgtcaactgctggcgaaactgcgtaccagctggaacaacaccaacgtgaccgacaacatgaacattgtgatgaccgacgatgttaaccagaaccgtaacggtgttgcggcgggtgaactgcagcgtgaaatcattagcaagaacctgccgcaacgtatcaccagccacaccttctacaacagcacccgtaaagcggatggtacctggaccggtccgagcgcgctgagcggtgcgggcaccgcgtttcgttatgttggtgatcgtcaagcggttggtgcgacccgtgatggtggcgtgcaagttctgggtgtgggcgcggatggtaacatttggcacaacctgcgtcgtccggatggtagctggcaaggttggaacgcgctgctggcggcggataacaagaacgtgggttttgcggcgaaagacatcgcgctgaccaccatgccgaacggcgatgcgcaggtggttgcggttggcaaggacggctacgcgtatcacaacattcgtagcgcggatggtggctggcaaggttgggcgagcatgccgggtcatgatgcgggtctgctgaaggcgaccaaagtggcggcggcgggtatgccggatggtagcacccaggtgctggttttcggtggcgacggtcgtatgcgtctgggtacccgtgcggcggatggtgcgtggagcagctggaaaaccgtggcgggtgttaacgcgccggactttgcgggtagcgcgctgagcattgcggcgctgccgaacggtgatagccaaatcgcggcgattggtaacgacggcaacgtgtggcacaccacccaccgtgcggatggtagctggagcgactggggtctgccggcgggcgtgagcggtggcgcgatggaggcgagcgcggttagcctggcgggtatgccgggtggcagcgtgcaggttgcggcggttggtcgtgacggcaacgtgtaccacggcgttcgtagcagcggtggcgattggaccccgttccaacgtgtgagcggtatcaagggtgcgggtgcgtttgcgggtgaccaggttggtattgcgggtctgccgaacggtagcagccaactgattctgaccacccgtcaccaccaccaccaccactaataagaattc

SEQ ID NO: 502 - DNA, 4751 bp, Artificial Sequence
  Optimized for E.coli
ccatgggtccgcgtcacaaggcgctgctgattggtgcgagcgagtacgacgatgaaaccattcgtagcctgccgttcgtgcgtgacgatctgcagcgtctggagggtgtgctgagcgaccgtggctttcgtccggttgagatcgcggaaagccaacgtggtattaccccgaacgcggtgaaccgtcacgttctgcgtttcctgcgtgaagcgggtcgtggcgacaccctgttcatcatgctgagcggtcacggcgtgcactttgacggccgtgattatctggttccggaggatgcgtactatgagagcgaaccgttcgcggagagctgcgtggaaatcggttggcagaaggagctggaagacagcccggcgggccaagtggtttttctgattgatgcgtgccgtgaaggtagcgcgcgtcgtaccaaaagcccgacccgtatgccgggttgggaacgtccgaagattgcggcgaccctgcgtcgtaaaattgcgtacgtttatgcgtgcagcaaggcgcagtacgcgctgtatgtggacgagagcgaagcggttctgccgcagcatgcggatgcggcgggtacccaaccgaaagatagcttcagcctgtttagccgtgctgtgagcgatgtggttagcgcggttccgcacaccctgcacatgggcgagttcctggatgaagttcaacgtcgtctgaccgcgctgcacaccgcgtatggtaaaacccagccggtgcaacgtgttcgtgcggaaaccgacattccgtggcaagagtttaccgtgctgccgggtccggcgcgtgatgcggcggaacacccgtgggttcgtagcaccgcgacccacccggcgtgggaacgtaccaccccgggtgcggcgcgtgaggcgctgaaggatgtgtgcgcgaccctggcggcgcgtctggcggaaggttatgaaaccgcggcggcgaccctgcgtgatgatccgtggcatgatgcggagctggcgaaacgtgcgcaggatcgtctgggcttcctgaccggtcgtctggcggcgggtgcggaactgagcccgaccgagggcgcgctgaccgttctgctgccgctgctgggtcaggcgttttggacccatgaagcggcgcaacgtgcgccggtggttaccgcgggtccggcggaccagccgaccccggagcgtgatcgtttcggcaagtttgcgcagggtttcccgcgtctgcaacgtcgtctgcgcaccctggaacagcgtggcgtgagcgatggtagcgcggagcgtatccgttggtggctgtttcaccgttggctgattcgtcagccggaactgtacgcgagccaaaccctgaagaccctgctgggtccgccgccgggtggtacccagtgcccggagtgggttaccgaagcgctgagcggcgaacgtttcatgcgttttctgcaagaactgcgtgcggcgccgtttgcggtgccgcgtgacaccccgggtcgtccgggtgatcagcgtgatggtgactgcgatgttatcgcggcgagcacccgtgacgagcacgaagtgcgtgagagcctggttgcgagcctggcgaaagcggcgcaagcgtttgcggtggacccggttgatctgccggagatcctggtggaacacatcggtattagcgacagcgttgacctggatgaactgctgaccaccattcgtggcagcgattggcgtaccagcggtctgggccgtagcctgaacgcggtgtgcggtcacccggcggttcagattgcgctgcgtgaacatgcgcgtcgtgtggatggtctgctgcgtgatattaaccgtaccagcgcgctggcgccgctgcgtagcctgccgccgtatgcggatgcggatcgtgtgcgtctgggtggcaacaccccgacccacctggcggatggtatccgtttccagctggcggaagatcgtgttcaagagctgctgatgggcgaggaactgtacggcgagcgtgaactggcgattcgtgaactgtatcagaacgcgctggacgcggttcgttaccgtgatcgtcgtaccgaatatctgcgtcgtaccggcgagatgccgacccaatgggacggcctgatcgagtttgtgcagaaagcggatgcgcaaggtcgtccgtacctggaatgccgtgacaacggtgttggcatgggtctggatgagctgcgtaacgtgttcagccagggtggcgcgcgttttgttgacctgccggaatatattgaggaacagaccgcgtgggcggagctgggtgaaccgcgtatcgagctgcacccgaacagccgtttcggcattggtgtgctgagctactttatgctggcggacgagatcgaagttaccacctgccgtatggcgcgtgatggtcgtccgggtaacaagtatcaggtgaaaattgcgggcccgggtaacctgttccgtgttgacgatctgggcccgggtaccgatagcggtaccaccgttcgtctgctgctgaccgaccacaaggaacgtgtgagctgcgttgataccctgcagcgtgttctgtggctggcgccgtatcgtaccagcgcggagcatggtagccgtcgtcatgagtgggaaccgggtcaactgagcctgagcggtccggaactggtgtgggcggacgatagcgagatgtttcgtcgtaccggtgcgtgctatccgagcggtaacccggatgtgtggtgggttgatggcaccggtcgttttctgagcgatggtctgctggcgagcaccaacagcgcgaccaccggtagcagcgcgcgtgagcgttatggtgcggtggttaacctgcgtgaacagcaccaaccggagctgagcgtggatcgtaaaaccatccgtagcaacgacgaagatcacgtgaacgcggttctgagcgaagcgctgccgagcctgttcagcaccgcgcgtccgctgctggtgccggactggctggttgaagcgagccgtagcagcgtgggctttggtgatgaggttgcggaacgtgcgcgtaccagccgtgttccgtggccggcgggtgacaccgagcgtccgttcgatgcgctgggcttctttcgtccggaccagaccctgctgccgctggtgaccggtcactatccggcggttcgtgaggaacatggtccgagctatctgcgtctggtgccgaccccggttctgcgttggcgtctgctgaccctgtaccgtgcgggtctgggtgacccgctgaccgaggcggcgcaggcgagcccgccgctgccgtgcgcgcgtccgagcgatcaccagctgctgagcgcgcaaggtagctacaccaccctgaactggacccaacgttataaggactggctgaccggcccggaaaacagcaccttctatctgctgaaaagcccgagccgtaccctggtggatagcggtatcctgagcgcgcacagcgtggaagtttggcgtgacccggagcaggtggttaccctggatgagatttttggcctggtgggtctgaccgagctgaccgcggaggcggttgcggagcgtctgaccgcgctgggttatagcgtggttccgccgaccggttgcgaacgtgttcgtcgtgaagacctgccgctgctgcgtccgctgggcagcgtgaccgatggttggctggagccgggtagcgatctgagcgttgcgcaactgtgcctgagcgcggcgcgtgcggaatgcagcacccgtgaggcggcggaccgtctgcgtgatctgggtttcgcggtgccgaccgaatatccgaacagcgatgcgtggaccgcggaggatcgtgaagtgctgcgtggcctgtgggacctgcacgcggatccggttccgccggaccgtgcgcgtgagatcagctatgcgcagctgattagcgttgcgcgtgcgagcggtgcgaccacccaagcggtggttgcgctgctgcgtgataccggtttcagcgtgccgagcccgggtaccccgggtctgatgtttcgtgacgaggaatgggcgctgctggtttacaacggtatcagcctgaacgtggatcgtccggttccgctgccgcacgtggttggtgtggcgtatcgtaccggtcaaaccccggaggcggtggcggttcgtctgcgtgcgctgggtttcgaggttccggaactgccggcggatggtccgctgccgagcaagcaagatatcaactttctgtacgcgcgttatgagagcagcagcggtaaagcgtggccgcgtccggaccgtccgatgggcctgggtgcgattgcggaacgtgcgggccgtagcaccctgagcatgaccgagaccgcggcgcgtctgaacggtctgggttatcgttgcgcgccggcgcagtggctgctggaccgtttccaagaacacgatgttgaggcgctgcgttggaccctgccggacgatgaccaccagaccgtgatcagcccgccgcaactgtatgcggttgcggaacatctgggtcgtccggcggaggatgtggcgcagagcctgaccgactttggttatgatgttgcggaaatcccgggcacccgtattcaagagcgtaaggcggaggcggacctgattgatgtgctgagcagcggcgaggacccggttatcgatattgcgtatgaagcggaactgagcctgccgaccctggcgaccgtggcgatgcgtctgggtctgccgttccgtaccgttgcgctgaaagcgaccgcgctgggtatgcgtcatgaggcggaaacctggtttgcggcgggccaccaccaccaccaccactaataagaattc

SEQ ID NO: 503 - DNA, 3872 bp, Artificial Sequence
  Optimized for E.coli
ccatggcgccgagcccgaccagcggtgcgagcagcagcaccccgagcagcggtccgccgagcgctccgccgagcgcgccgccgcaggctccgccgagcgaggcgaagcgtgcggcggagcgtgcggcggaaccggcgggtccggaacaaaccccggctgctgctgcggcggcggcggcgccggctgtgagcgatgcggtttatgcgtatgatgcggcgggccgtctggttggtagcaccgatccggcgggcgagaccgcgcgttaccgttatgacgaagcgggcaaccgtctgggtatcgatcgttttgcgagcgcggacctgagcgtgctgagcctggttccgacccgtgcggcggttggtgcgaccgttaccctgagcggtaccggtttcagcaccaccccgagcagcaacgcggttagctttggtggccagaccgcggaagtggtttctgcgagcgcgacccgtctgaaagttaaggtgccggcggcggcggtggcgggcaaagttagcgtgaccaccggtggcggtaccgcgcaaagcccggaaagctttaccctggcggcgccggcgccgagcgtgaccaaagttgatccgaccagcggttatgcgggtaccgcggtggttctgagcggtgcgggttttgcggcggcgaccgcggacaacgtggttcgttttggcggtggcgtggttgcggagatcgttgaacgtaccgataccgcgctgaaagttctggtgccggcgggtgcggcgaccggtccggttgaggtggcgaccccggatggtcgtaccaccagcgcggcggcgttccgtctggtggcgggtgacggtggcggtgagattgaaaccagcgtggagaccagcgttaccgatgaaaccccgccgaccgttagcgtgaccaccccgggtaaccaggcgcaagtggtttttgacgcgaacgcgggcgacgatatcagcattggtttcaccgaaagcacctttaaccagaccgttaccgtgcgtctgctggatccgcaaggcaagcgtctggagagcgcggcgtacaccggtaccgcgggtgattgggaaatgaccgacgttccggttagcggccagtatagcgttatcgtggacccgggcaccggtaacattggcagcgttaaagtgaccgttagcaacccgcgtatcagcgcgctggatctggcgggtccggcggtggacgcgcagttcacccgtccgggccaagatcacctgctgacctttgcggcgctgctgggtgatagcctgagcctgggcattgacgcgaccggtctggcgaagagcacctacgcgcgtctgtatggcccggatggtgcggagatcgacaaagtgtacgttaccggtacccgtattggcggtctggacgttgatgcgctgacccagagcggcacctataccctgcaactggacccggatgcggcggcgctgggtaccgtgaaggttaccggtagccattatgcggatgcgggtaccctgaccgcgaccggtccggcgctggatgtgagcctgatccgtcagggccagcaaggtcgtgcgcaattcagcgcgcaggcgggtcaacgtgttagcctgggcggtagcgcgaccggtttcggtaactttacccgtgttgaaattcaccagccggatggtgcgctgctggactactttctggtgccggacgcggatgcgggtcaatgggacagcgcgaccctgaccaccagcggtacctataccgtggtggtgaagccgggtagcccgctggcgaccggtaaaatgaccctgaccctgagccgtccgctggcgctggcggcgctgaccaccaccgcgagcgcgagcgcggttaacatcacccgtccgggtcagaacgcggagagcagcttccaagcgcaagcgggtgcggacctgagcctgggtttcaccgcgaacacctttccgcaatacattgatgttaccgttaccgcgccgagcggtgcgaaggttgttgatggtgttaacgttaccgcgggtgcggcgaccaccattccgctgccggtgctgaccgaagcgggtacctatcaggttgtgctggatccgaacaagggtgcggtgggtgcgaccagcctgaccctgagcgcggttgcgcgtgcgaccctgaccgcggatggtgcgcagcaaccgaccaccgttgcgcgtgcgggtcaacgtgttcgtgcgaccttcaccgcgccggataccgcggcgctgggcctggcggttaccgcgaacaccattgcggagagcaccgaaatccgtctgattggtccggatggcggtgcgggtgcgctggcgggtcgtgtggcgagcaaggcgagcgataccttctacctgaccggcctgaccagcggtaccgcgtatcagctggtttttgagccggcgaaagcgaccaccggtgcgatgaccctgtggctgagcaagccggtgaaagcgggtaccctgagcaccaccgcgccgaccctgaccggtgaaattacccgtccgggtgcgcagctggagttcggtgtgaacgcggttaccggctacggtgcggcggttgtgtttagcggtaccaccctgaccgagaccagcgcgctgattcaccaaaccccgggcggtgtggaagacaacgttggtagcctgagcaaggcgaccctggatgcggatctgcgtgcgccgctggcggttggcggtcaccgtgtgttcgttcgtccgaacggcagcgcgaccggtaaaaccaccgcgaccctggttccgaacgttaccggcggtgcgctggcgaccaccggtaccaagaaaagcgtggcgattgcgaccgcgggtcagaacgcgcactatacctttaccggcaccgcgggtcaaaaactgaccctgggtctggacaccccgccgggtgcgtggagcctgagcgtgcacggcccggatggtaaatggctggttgacggtcgtaacatgagcgcgaccaccgttagctatgcgctgccggcgctgccggcgaacggtacctataccctgagcgtggatccgaacagcctgaagaccggcacctggaacctgggtctgaccgcggcggcgaccctgcgtgcggcgaccgcggcggacaccgcggatggcccggacaccgcggagggtgcggataaagcggcgggtgcggatgaaccggcgaccccgaaaccgccggcggcgggcgttaccccgaccggtgcggatgcgtggcagccggacaaaggcaacctgagcggtcacgattggctgacccgtcgtggtgacgcgccgaaggctccgccgaccctgcgtgctccgccgaaaaccaccgcgctgaccggtcacgtgctgaagctggacggcaaaccgctggcgggtgtgaccgttagcgcgggtgcgaacaccgcgcgtaccgatgcggagggtcgtttcctgctggcgggtatcagcccggaagcgaccaccctggttgtggacggtgcgagcgcgaacaccaagcagcgtcaatacggccgttttgatatccgtattcgtccgaaagcggataccagcgtggacctgggtttcccggtttggatgaccccgctggatatgaagaacaccgttcgttttgcggcgccggcgaaaaccgacgttgtgctgaagaccccgaaaatcccgggtctggaagtgcgtattccgaagggcagcgttgtgcgtgacgagaaaggtcgtccggtgaccgaactgggcattaccgcgatcccgattgatcgtccgccgttcccgctgccggaaaacggtgttgtgccggtgttctttaccgttcagccgggcggtacctatgttttcccggagggtgcggaccgtctgccggaactgcacgcgcaccaccaccaccaccactaataagaattc

SEQ ID NO: 504 - DNA, 2843 bp, Artificial Sequence
  Optimized for E.coli
ccatggcggcggacgatgtgatggcgatgagctaccacgttcagggtgatcgtatctttctgagcggtggcgtgacctatgcggatgtggttagcctgccggcgctgctggcgaaagcgcaagcggagggtcgtccgatccgtgaagtggttctgcgtaccagcaacggtggcgcgctgattgcgggcgagtggctgcagggtgtgatccgtaccagcggtctgaacaccattgttagcggccactgcatcagcagctgcagcattatgcagagcggtggcgtggaacgttacctggcgggtgatctgccgatcgtggacagcgttcaaattcacgcggcgagcaacagcggcaaggttatctataccccgagcccgcgtatgacccagatctacaccggtaactatggtggcggtattgatgcgggcctgctgcacaaagcgatgtacgaggtggttcaaccgaacggtctgctggtgtttcgtgacccggcgcgtaccaccggtgcgagcgttaccttcgatccggacggtagcggcagcaagctggaaagctttccgggtcaggatatctacagcaaccgtgtgattaccgcgaaaggctatcgtgatccgggtgacaccctgaacgtgaccgcgaacgttagcggcgacatcaacccgggttacctgcgtaccggccgtcagctgcaaaccttcgttgacgatgactttgcgcgttggaacaccaactggcagagcagctacatcaacctggcgcaaagcatttataacgcgagcagcaacggtccgcagggtattggcgcgaacagcgtgcaggattaccaaaacgacccgacctataaggcgctgctgctgagcaaactgcgtctgggtgatctggacgttagcaccctggacaacagcatgggtgtgatccgtgttaccaacggtgcgacctggcgtaccagcgcgaccaccggtgcggattttatgctggttgacaacggtaccattgcgctggagggcggtgcgctgcgtgcgagcgaagtgcgtgttatggcggcgggtatgctggttggtaacggcgatgttgcgggtaccgcgatggacctgagcgcgctggcgagcggtacccgtccgagctggcgtgaggatggttttaaccgtctgcgtgtttatggtaccctgatgccgcgtggcggtgacctggtgacccacggttatgttaacatcatgccgggcggtaaagtgctgttcgacgttaccgagaacggcggtgcgggtagcggccgtctgcgtgtgggtagcttctttgatagcaagcagaccgacggtgcgctggtgattagcaaaggcgcgttcctggaactgaacgttgcgcagggctactatggtcaagattttcgtcgtgacctggttcagggtccgatctaccaaggcggtttcgaggaagtggttcgtctgggcgataccggttatagcgcgagcattaccggcggtgaagtgttccgtccgcgtcacaacagcctgctgagctttaacgttaaacaagcggcggatggtctgtggctgaccgcgaacccgggtttcgaccaactgggcctgtttaccaaccgtaccagcggtgatggtctgggtcgtgcgctggcgaccgcgagcgatcgtcgtgatggcggtctgaaaagcctgctgggtgcgctgcaattcgcggatcgtgatgtgattgcgcagcaagcgggtgcgctgcgtggtgatgcgcatgcgaccctgcgtctggcggacaacgcgctggttggcagcattggtaacgtggttcaacagcatcaagcggcgatgcgtagcggcggtgatgcggatggtctggcgagccaagcggcgcaaagcgtgagcgcgcagccgggtatgcgtcacggtagcctgtttaaccaactggcgatgcacctggttgaaccggcggcgggcggtggcgaaggtagcggtccgggtcgtaaccacggtctgtgggcgcgtggcttcgcgagccacggtcgtatcgatgcggatggtggcgttgcgggtctgagccacaacatcggtggcattgtggttggcgcggatacccgtgtggcggatgaccgtgttaccctgggtgtgagcgttgcggcggcggacatgagcaccaaaggccgtgatggtagcgactttagcggtgatgtgcgtgcgctggacgttggtggctacctggacgcgacctatagccgtggctatctgagcgcggcggtgcgttataccgatctgcgtcacgacacccgtcgtagcgttagcggcatcgatggtctgcagcaaccgctgcgtgcgaagtacagcaacgacgcgattagcgcgcgtgtggagcacgcgttcagctttaccaccggtaaaggcctggttatccagccgctgctgccggtggttgactatgcgcgtaccagcgcgacccgtttcaacgaaggccagggtgcgggtgcgctggttggtcgtagcggtagcctggaaagcatccgtgttggcgcgggtctgcagctgttccgtacctttgagggcaacaacggtgaacgtattaccccgcgtgcgcgtgtggtttggcagaaggagctgggtgatagccaagcgcgttacagcaccggttttgcggcggcgccggacctggtgtttggtgcgagcagccaggcggtgggcgaacaagttctggcgtggaacctgggtgttaccagccgtgcgagcgagcgtctgagcatcatggcggattatgtgggcgaacgtcgtgacggtcagattcaaaacggcgttatgctgggtctgggttataaattccaccaccaccaccaccactaataagaattc

SEQ ID NO: 505 - DNA, 1997 bp, Artificial Sequence
  Optimized for E.coli
ccatgggtagcccgagcgatgcggcggaggaagcgggtcacctggttggtcgtggtattgcggatgtgaccggtgaagcggcggagaccggtatgatgggctacagcagcttcgaccagaagaccagcggtattcaccagcgtcaacgtagccgtgcgtttgtggttgtggaccgtagcagcggcaaacgtgttgtgtatgttaacgcggatctgggtatgatcttccagagcgttcgtcaaggcgtgatggcgcgtctgaaggagcgttacggtagcctgtatggcgaggaaaacgttctgctgagcgcgacccacacccacagcggtccgggtggctacagccacaacgttgcgtataacctgagcgtgctgggttttcagaaagagacctaccgtgcgatcgttgatggcattaccgaaagcgtggcgaaggcgcacgacgatctgaaaccgggtaccatgagcctgggtaccggtaccctgaccaacgcgagcgttaaccgtagccgtgaagcgtttgaccgtaacccggcggcggatcgtagcgcgtttccggacggtatcgatccggcgatgaccgtgctgcgtttccgtcaaggtggcaaggacgcgggcgcgattagctggtttgcgacccacaacaccagcatcaccaacaagaacaccctgattagcccggacaacaaaggttacgcgagctatgtttgggaacacgatcacgagggtgtgcgttacctggacgataccccgggcttcgttgcggcgtttccgaacaccaacgcgggtgatatgagcccgaacctgaacctgaagccgggtagcggtccgaccgaggacgagttcgagaacgcgcgtgttatcggcgagcgtcagctggataaagcgcgtgaagtgtatgacgatgcgcgtccggttaccggtggcgtggacagccgtattgcgtacgtggatatggaaaacgttaccgtgcgtccggagtataccccggacggcaaggaacaccgtacctgcccggcggttgtgggtgcgagcaccctggcgggtagcgttgaggatggtccggcgatcccgctgttcgaggaaggtatgcgtaccccggttgcgaccgtgctggaagcgctgcgtgttgacaccccgagctggctggcgacctgccagtacccgaaagcgagcctgattccgaccggtctgctgagcaacgttcatccggtgaccccgaagcgtctgccgctgcaaatcatgaaaattggtgaactgcacctggttgcggcgccgggtgaatttaccatcaccagcggtctgcgtgttcgtcgtaccgttgcggagcgtctgggtgttccgctggaccgtgtgctgctgcagggctacgcgaacgcgtacagccaatatgtgaccaccccggaggaatacgatacccaaaactatgagggtggcagcaccctgtacggtcgttataccctgccggcgtaccagcaagaatatgcgcgtattgcggacagcctgcgtgcgggtaccgcgctggaacgtggtaccatgccggcggatgaaagcggtcgtcagttcacctttcaaaccggcgttgtgtacgataacccgccgagcggcaaggcgtttggtgcggttctgaaagcgccggagagcagctacgcgcgtggtagcaccgcgaccgcggagttcgcgaccggtcacccgaagaacaacgttcgtcgtggcagcacctttctggaagtgcagcgtctggagaacggcacctggcaacgtgttctggacgatggtgatggcgaaaccgtgtaccgttggacccgtatcaacggtctgaccggcaccagcaaagcgaccatcacctggcgtattgcggcggacaccgcgccgggtacctatcgtatcgttcaccacggtgatgcgaagaacctgctgggccgtattaccccgttcagcggtgcgaccggcgcgtttaccgtgaaacaccaccaccaccaccactaataagaattc

SEQ ID NO: 506 - DNA, 2093 bp, Artificial Sequence
  Optimized for E.coli
ccatgggtctggagccggcggcgctgaacggtgcggttaccgcggcggcggatggtgtggatggtagcggtacccaagcgggcctggttggttatgatggtgcgccgggcgagaccggtaccgcggaaggtgcgacccaggtgccggcgccgaagcgtgaccaaaaagcggcgccgctgaaggcgatcccgaaagatgagccggaacgtggcctggtttatgcgggtctgagcctgccgggtagcgaccgttgcggtggcaccctggaagtgaccggtagcacccaatgcagccacggcccggatgttccgccgaagggtgtggacattcgtcaggatgttccgccggtggcggcgccggttgcgcgtaccccggcgctgaccccggcggcgggtgcgcaggcgccggcggcggcggacctgctgaaaggtagcgcgccggtgctggatgcgacccaaaaagcgctgctgggtggcgcgggtaccgcggcggatgcggcgcgtgcgggtgcggatgcgccggcgggcagcaaactggtttgcgagggcgacggtagcagcggtaaccgtgttcaggtggtttacgtgcacagcccgggcaacgatcgtttcgcgcaatatctggcgagctttaagaaatgggcggcggacgtggatgttatctacaacgcgagcgcggcggagaccggtggcgaacgtcacgttcgtttcgtgaccgagagcgactgcagcgcgagcgttctgaacgtgcagatcagcgacgcggaaattcaagattttaacgcgagcaaccgtgcgctggcggcgcagggtttcaaccgtaaggaccgtaaatacatgatgtttaccgatgcgaaggtttattgcggcattggtaccttcgcgggtgacgaacgtccgggccaagataacctgagcaactttggcccgagctacggtcgtaccgatagcggttgctggagcggtagcaccgcggcgcatgagctgggtcacaacctgggtgcggttaacaacagcgtgccgaacagcagcaaagcgggtcactgcgttgacgaatgggatgtgatgtgctacagcgacgcgccggattatccgcagatgcgtaccgtgtgcccggaccgtgcgcatgatgatcgtctggattgcaaccacgacgattactataacaccagcccgagcccgggtagctatctgaccacccactggaacgttgcgaacaaccgtttcctggtggcgggtggcggtagcggtccggacccgaccccgaccccgaccccgacgggcaccccgacccgtaccccgagcccgagcccgaccccgaccggtagcaccaccccgaccccgaccggcagcccgagcccgaccgcgaccccgactgctaccccgactgccaccccgaccccgactgctaccccgacggcgggtaacaccggtccggcggtggcggttagccaggttacccaaaacagcgcggtgctgagctggaccgcggcgccggcggcggcgggttacgatgttctgctgaacggccaggcgatcggtaccgtgcgtagcaccgtggttggcgtggttcgtctggcgccgggtaccagctataccgtggcggttgcggtgcgtgatgcggcgggtgcggttggcaagccgggtcgtaccgcgacctttcgtaccgtgaccgataccggtcgtccgcagccgggtacccgttacacgatggtgaacggtctgaccggtcaagcggcggacctgtggggtagcagcatgaacgatggcaccgtggcgatcgcgtaccaacgtaccggttatgcgaaccagaagtggcaattcgaggacgcgggcaacggtgcggttcgtattaagagcgcgcgtagcggtaaatgcctgcagctgggcggtgcgccggttgcgggccaatatgttgcgcagcaaccgtgcagcgacaccgcggcgcagaaatggcaactgaacgcggttgagggcggttttaccgttaccgcggatggcggtagcctggtgctgggtctgagcacccgttggtactatggcggttggctgctggaactgcagcaccaccaccaccaccactaataagaattc

SEQ ID NO: 507 - DNA, 2312 bp, Artificial Sequence
  Optimized for E.coli
ccatgggtaaaaacaacgacgtgccgttctacaacggccagaacgatagctttctgaccagcctgaacctgcaactgccgggcaagtactatcgtccgggtagcggctacgcggcgaaagagagcctgtatcgtgcggacgtgcacttcccggcggtttataacggcagctttaactgggacaacccgcgtgagaacctggtgcaggcggaggataccagcgaaccgtacatccgtattgcgaacgaaggttatctgaacagcaaggttccggcgggcgatcgtatggttaccgaggtggaacgtgttaacaacagcgttatcagcagcaaatactggggtaacccggagttcgtgctggaaaacatggacaagcacatgattcagacctacgagagcttccgtgaactgggtcaattttattggatccgtgatattgcgtatctgagcggtggctatgcgggtgcgagcggtgttggcaacatcaacaaatacagcctgtggtacgtgcgtaccagcaaaccgcaggtgaaggacttccaagcgatgagcggtaagaaagatattccggttaaattcacctttaagggctttgagtacgtgagcaagaacaaaggttataacgaccgtgatccgaacggcaccaccgttaacccgtaccagaaggcggcgggtgaacgtaaccgtgtgaaatggatgctggacatcaccaaggatggcgagaccgtttaccaccaggaaaactatctgcgtagcaccccgcagaaagacaaccaaaagccgaacgagggtgatgcgggccaattcaagaaagaagacatcacctggcagccgcaactgtgcggccagtacaccgcgaagattaaagtgctggacgcggttcaacgtgagagcaacgaaaaagcggttgactttaccatcgatggtaactgcggcaccgaggtgaccccgaacccggacccgggtgatgaagacgatttcaagtacaagatcgacttcagcgcggatcgtattgagggtgaaaccgcgcgtgagggcaaaaacattaagacccgtgttgacgtgagccgtgataacttcaagctggaacgtgaccagtaccgtgcgaaagtgaacaacaacatcaacaagagccagcaagagattaacagcaccgaaagcgaccgtgatagcgcgcaaagcagcctgagctattgccgtcgtaacccgatccacgaggttgacgcggagggtaaagatcactactatgaccgtgattgcagctgggaggaaaacaaactggacagcgcggcgagcaagctggataacgcgcgtcagaaactggagaaggagaagaacaagattaagaaactggacgtgctggaggaaaagtacatgaacccggagaccgtggttgtgctgaagcacaacggtcagcaagtggcgctgcaaaaagttcgtctgaccgagggcgaaaagaaaaccctgaacctggactggcagcacaaaggcaagggcaccatccaagcggaaattaacccggcgggtaaccgtatcgatattgaggaaaccacctacaaaaacaacccgatcaagaccgcgatttatgagccgagcaaagaaaaggcgatgtgcggtgtgaccagcgttaaaggcgttgtggagaccgtgagcgaacgtgttagcaaagaggacatcaccggtgcgatgtactatgaaaccctgaccggtagcattggcaacctggcgccgagcaaactgcacagcggttacggctttagctatgaggtgaacggtaaatacaagaacgattggaacgcgaactatccgggcgttttcaccgcggcgaaggcgcagtacccgtttgcggatgaaggtctgaaaagcacccaagacctggagaagaaagaactgaaggataccaccgcgaaattcctgccgaagaacatgtacctgagcgaggcgaccggtcacgtgtttgacagcaaacgtccgaccaagagcctgtattgggacggccaggaaaagatcattgatggtggccaaaaatggtacagcccgctgaaaaccaagaacggtgtgtataccttcaacgttgagaccgcgccggcgggcatcaacgaaatgagcctgtgcctgaccgagcaggtggaaatcaagggtgttgcgtacgacgattttattaaacgtcgtgtttttccggatgatccgttcccgggtggcagcggtgtgggttggaactgggttggcaaagaggacgtgctgtataagctgaccgattggtactatatgcgtaaccgtaagcaccaccaccaccaccactaataagaattc

SEQ ID NO: 508 - DNA, 2864 bp, Artificial Sequence
  Optimized for E.coli
ccatggaggataccaagggcgaacaagtgagctaccgtaacgttctgaaaatggaaccggtgggtgttcaactgccggtgcaggagctggcgcacagcagcaaggttctggagagcaaaagcttcgaaaagcgtctgcaatttgcggacctgagccagcgtccgccggaagtgaagaaggagagcaagcaactggcggttgcgaaaacctacaccatcgcggaactgaaccagctgagcaaccagcaactggtggacctgctggttaccatcgattgggagcaaattaccggtctgttccagtttaacaccgacagcctggcgttttaccaaaacgatagccgtatgcagaccatcattgacaaactgaagcagcaaggccaggcgtataccaaagacgatagcaagggtatcgagaccctggtggaagttctgcgtagcggcttctacctgggtttttataacagcgagctgagcaaactgaacgaacgtagctaccacgataagtgcctgccggcgctgaaagcgatggcgaacaacagcaacttcaagctgggtaccctggaacaaaaccgtgtggttagcagctacggcaaactgattggtaacgcgagcagcgacgttgagaccatcaccagcgcggcgaagatcttcaagcagtacaacgacaacttcagcaccctggttgataacctgagcgcgggcaacgcgatctacgatattatgcaaggtgtggactatgatatccagagctacctgtatgacacccgtaaagcgccgaaggataccgtgtggtaccagaagatcgacagctatattaacgaactgagccgtttcgcgctgatgggcaccattaccgcgaaaaacggctggctgatcaacaacggtatttactataccggccgtctgggcatgttccacagcaccggcaccaagggtctgcaagtggttaccgatgcgatgaaaatgtacccgtatctgggcgagcaatactttgttgcggcggaacagatcgcgaccaactatggtggcaaagacgcgaacggcaaggtggttaacctggaccagattcgtgaggatggtaagaaaaagtacctgccgaagacctataccttcgacgatggcgcgatcgtgctgaaagcgggtgataaggtgaccgaggaaaaagttaagcgtctgtactgggcggcgaaagaagtgaaggcgcaatttcaccgtaccgttgagagcgaccagccgctggaaaaaggcaacccggacgatgtgctgacgatggtgatttacaacagcccggcggagtatcaattcaaccgtcagctgtacggttatgagaccaacaacggtggcctgtacatcgaaggcaccggtaccttctttacctacgagcgtaccccggaggaaagcatttatagcctggaggaactgttccgtcacgaatttacccactacctgcaaggccgttatgaggttccgggtctgtggggccagggcaagatctacgagaacgaacgtctgagctggtttgaggaaggcaacgcggagttcttcgcgggtgcgacccgtaccgataacgtggttccgcgtaagagcatcattggtggcctgagcagcaacccggcggagcgttacaccgcggaacgtaccctgaacgcgaaatatggtacctgggacttctacaactatagctttgcgctgcagagctacatgtataacaagcgttacgacatgttcgataaaatccacgatctgattcgtaagaacgacgtgaccgcgtacgatgcgtatcgtagcaccctgagcaaggacgcgaacctgaacaaagaataccaagactatatgcagatgctggttgataaccgtgagaagtacaacgtgccgctggttagcgacgattatctggcgaaccacgcgagcaaaccggttagcgacatcgcggcggagattaccgcggaagcgaaactgaagaacgtgagcgttaaaaagaacaagccgcaattctttaacacctttaccctgcagggtacctacaccggtaccgcggcgaaaggcgagtatgaagattggaagaccatcacccaaaacgttaacgacaccctgaaacgtctgagcgcgaaggagtggaccggctacaagaccgtgaccgcgtacttcgtgaactatcgtgttaacaccagcggccagttcgaatatgacgtggtttttcacggcatcaacaccgaggaaggtgctgagaacaaagcgccggtggcggttatcaacggcccgtacagcggtaacgttaacgaagcgattagcttcaccagcgatggcagcaaagacgaggatggcaagattaccagctataaatgggaatttggcgacggtgctgtgagcaacgagcagaacccgacccacgtttacaccaaagaaggcacctataccaccaagctgaccgtgaccgacgataaaggtgcgaccaacaccgcgaccgcgaccgtgaccgttcagaagaaagaggacaacagcgttgagaaggaaccgaacaacagcttccagaccgcgaacaaactgcaactgaaccaagtgctgcgtgcgagcctgggtaacggtgacaccagcgatttctttgagatcaacgtggaaaccgcgaagaacctgcaaatcaacgttaccaacgaaaacaacattggtatgaactgggtgctgtacagcgaggcggacctgaacaactacgttacctatgcgcagcaacagggcaacaaactggtgggtagctactatacctacccgggcaaatactatctgcacgtttaccagtatggtggcggtaccggtaactataccgttgaggtgaaacaccaccaccaccaccactaataagaattc

SEQ ID NO: 509 - DNA, 575 bp, Artificial Sequence
  Optimized for E.coli
ccatgggtcacggctacatcaaggagccggttagccgtgcgtatatgggtgcgctggaaaaacagaccctgggttggaccgcggcggcgcagaaatacggtagcgtgattgacaacccgcaaagcgttgagggtccgaaaggttttccggcggcgggtccgccggatggtcgtattgcgagcgcgaacggtggcagcggtcagattgactttggcctggataagcaaaccgcggactattgggtgaaacagaacatccgtggtggcttcaacacctttacctggtactataccgcgccgcacgcgaccagcaagtggcactactatatcaccaagaaaaactggaacccgaacaaaccgctgagccgtgatgagttcgaactgattggtaccgttaaccacgacggcagcaaggcggataccaacctgacccacaaaatctttgtgccgaccgaccgtagcggttaccacgttattctgggcgtgtgggacgttgcggataccagcaacgcgttctataacgtgattgatgttaacctgacccagcaccaccaccaccaccactaataagaattc

SEQ ID NO: 510 - DNA, 1019 bp, Artificial Sequence
  Optimized for E.coli
ccatggactacgatccgaagaaaaagggttggtacgtttatggtcacggccaagttagcgcggacggcaaacaagtggttccggatgcgaagacccgtgtgtgggcgttccacggtgcgatgtttaacaccggcgacatcctgccgtgggatatgggttggctgcaggacgtgattgattggctgagcggtgacccggttgagctgaccaccggcatgctgaccgacagccgtaccgatctggcggtgggtggcaccctgggtagcgcggagatcacccgtacctattggcaaggcgacccggaaaaacgtgcgttcggtattggccgtgatctgagctacaacgcgtttctgcacagcaaaaagcagtggcaagaggttgacctgtatctgccgggtggcagcaagacccacttcacccgtaccagcaccggtaccgactggaccaacgcggtgttcgaaccgctggatagcccgagcggttttcgtggcagcaaactggtttggaagggttacgacggtggctgggatctgaccttccgtgacggcagcgtgtgggtttttccgcagtatgcgccgctgaaagaaatccgtgatcgtcacggtaacgcggtgaaaattacccgtctggacggcaagcgtggcgatatcacccgtattagcgcgccgggtggccgttggatcagcctggcgtacgacgcgcaacaccgtgttaccggtaccaaagataacgcgggccgtaccaccgcgtacacctatgacaccgcgggtcgtctggacaccgtgaccgatccggcgggcaaagttagccgttacacctatgacggcaccaccaaccgtatccgtaccgcggtggatgcgtgcggcattacctatatgagcaacacctttgatgcggcgggtggcagccgtaaccgtcgtagcccgcgtgttcgtagcaccccgagcagcaccccgcgtccggcgcgtgcgcgtagcccgcgtcgtccgcaccaccaccaccaccactaataagaattc

SEQ ID NO: 511 - DNA, 380 bp, Artificial Sequence
  Optimized for E.coli
ccatgggtagccaacatgcgccggatggtaccgaaggtcaaaccctgccgttctgggtggacgtggttgaggaagagggtgatgaaggcaacgcgatgggtggcctgtttcgtcacgatggcgagaccgtgctgcgtagcgttccgctgggtccgctgcgtaagaacctggcggacaccgttgatgcgctgcagaaagtgttcgaagaggttgcggaccgtggtggcgcgctgccgctggcggaggcgcagctgagctttcaagtgaccgcgaccggtggcatccaactgattggtagcggccaggttcaaggtacccgtggcctgaccctgaccttcaagcgtccgagccaccaccaccaccaccactaataagaattc

SEQ ID NO: 512 - DNA, 464 bp, Artificial Sequence
  Optimized for E.coli
ccatggcgaacctgagccgtgcgggtagcctgaagggcgtgaacctgttcaacggtagctggaccgttgcgatccaggcggcgaacctgcaatatgttagcgcggagccgagcggtaacgtggttgcgaaccgtaacgcggttaacgagtgggaaaagttcgagctgattccgaccggtgaactgtacacctttgcgctgaaggcgaaaagcaacggtaaatatgtgagctttgagccgaacggtcgtgtggttgcggaccgtaccagcatcggcgcgtgggaaaaatttattctgtacaacggtggcgataaccgtatctatgtgctgcaggcgctgagcaacggtcgttttattagcgcgaacggtggccgtgagctgaccgcgaacagctacgttgcgggcagctgggaacgtttcgtgatcgtttattttcaccaccaccaccaccactaataagaattc

SEQ ID NO: 513 - DNA, 263 bp, Artificial Sequence
  Optimized for E.coli
ccatgggtgtgaccaccctgaccggcaaccagagcgacaacccgaccaccgttgcgctgagcgacaccggtaccacccaaaccgatctggcggcgggcaagccgaccagcgagagcagcaacaccgtgaccctgaccttcccggcggcgaccgaacactactttcacgcgctgatcaccgcggatagcggtcgtccggcgggtcaagttagcgagttccacatttggagcagccaccaccaccaccaccactaataagaattc

SEQ ID NO: 514 - DNA, 2930 bp, Artificial Sequence
  Optimized for E.coli
ccatggcgatcccgacccaagaaccgggtgttaccctgcgtgtgttcgacgttcagaccccgctgagcaagctgtgcaccctgaaaccgggtcagaccccgaaccatgatgcgctgaagagcaccgtggactggagcaccaccgacgatttcggtggctttagcgaccgttttgtgagcgaagttaccggttacctggtggttccgagcgatggcacctatggtctgcgtctgaccagcgacgatggtagccgtctgagcatcgacggcgataccgttattgatcatgatggtctgcacggtgcggagccgaaggacaccagcgtgcagctgaccgcgggtagccacccgctgcgtattgatcacttcgagcgtgacggtggccaggaactgcgtctggcgtggaaaccgccgggtgcgagcgactttaccaccgttccgcgtgaagcgctgagcaccgatgcgggcgtggttcgtgtgaccgcgccgggtcgtaaagagtgcgaagcgagcggtgacaccccgggtgatggtctgccgctgaccgacgttcgtccggatctgaaactgaccgacctgcgtccggatggtttcgaaccgcaggtgaccggtatggactggctgccggatggtcgtctggcgatcagcacctggggtggcagcgataacgtggcgggcgaagtttacctgctggacaacgttaccggtgacaccagcaaggataaagtgaccgttaagaaagtggcgagcggtctgcgtgagccgatgggtattaagtacgtggacggcagcctgtatgttagccaaaagcacgagctgacccgtctggtggataaaaaccgtgacgatgttgcggacgaataccgtaccgtggcgacctggccgtatggtaaaaacttccacgagttcgcgtttggtctgctgtaccgtgatggctacttttatgtgaacctgagcgttagcatcaacctgggtggcgcgaccaccgttccgcagccggcgccgggtcgtggcaccacctataaagtgagccgtaagaccggtaaaattagcccgattgcgggtggcctgcgtaccccgaacggtatcggctggggtccgaaaggcgaaattttcgcgaccgacaaccaaggtggctggctgccgagcagcaagctggtgcacgttaaacagggccgtttctttaaccactacaccgaaccgagcggtgcgttcgatgcggcgaccccgaccgcgccggttctgtggctgccgcagaacgagatcgcgaacagcccgagcaccccgctgtatgttaagaaaggccaattcaagggtcagatgctgattggtgacgtgacctacggtggcctgcaacgtgcgtatctggaaaaggttaaaggccagtaccagggtgcggtgtttcgttatacccaaggtctggaggcgggtgtgaaccgtctgagctacggcccggacggtagcatctatgcgggtggcctgggtgcggatggtaactggggccaagagggtaaactgaaattcggtctgcagaagctgaccccgaacggtggcaacaccttcgacgtgaaaaccatgcgtgcggttccgggtggctttgatctgacctacacccaaccggttagcgcgaagaccgcggaggaactggcgaagcactataaagcggaacagtggcgttacaccccgaccagcgactatggtggcccgaaaattgcggaggaagtgctgccggttcgtagcgcggagctgagcaaggataaacgtaccgtgaagctgcgtctggacgatctgaaaccgggtcgtgtggttcacctgcgtagcccgcgtccgttcaccagcgaaagcggtgaaagcctgtggaacaccgaagcgtggtacaccctgaacgcgatgccgggcaagcaaccgccggcggcgaccctgtatgaagcggaggaagcgcgtctgaccggtaccgcgggtattgcgaccgaccacccgggttacagcggtagcggtttcgttgcgcgttataacaccgagggtaaagtggcgaccacctttgatgtgcaggttaagaaaagcggcacctacgacgttaacctgcgttatagcaacggtccgaacccgtttcaaggcaccaagagcctgagcctgtacgcgaacggtaagaaactgcgtcaggttaaactggcgagcaccagcgactggaacagctggagcacccaaaccgagcaggtggaactgcgtaagggtgataacaccatcagctatcgtttcgaggcgggcgataccggtcacgttaacctggacctgattaccgtgcgtccgaaaggtgcgagcctggcgctgtttgatggtaccgcggcgagccagagccaatggcagcacaccgatggtcgtcgtctggaatggccgctggcggatgagggtagcatggaagtgtgctgcggtgatatccgtaccattgacgcgtaccaagatttcaagctgcacgcggagtttcgtgttccgctgctgccggacgatgtgaccggtcagaaccgtggcaacagcggtatcttcattcaagatcgttacgaactgcagatcctggacagctatggcgataccaccctggacaccaacgaggcgggtgcgatttacctgaagaaagcgccggatgttaacgcggcgaaagcgccggagacctggcagacctacgatatcgtgtttcgtgcggcgcgttatgacgatagcggtaagaaaaccgcggacgcgcgtctgaccgtggtttggaacggccaaaaggttcacgacgatattaccctggatagcccgaccgcgagcggtcgtgcggaaaccccgagcaccggtgcgatccgtctgcaggaccacggtaacaaagtgcgtttccgtaacattaccctggagccgctgacccaccaccaccaccaccactaataagaattc

SEQ ID NO: 515 - DNA, 2930 bp, Artificial Sequence; identical to SEQ ID NO: 514
  Optimized for E.coli

SEQ ID NO: 516 - DNA, 3626 bp, Artificial Sequence
  Optimized for E.coli
ccatgggtcatccggacgagccggccgcggaggagagcttccagcaggtgaccctcgcgaagggcgccgacgcggtcggcgagcccatgtcgctcgccgtcctgcccgaccgccgggtgctgcacacctcgcgtgacggcacactgcgcatcaccgacgccggcggcgacaccaccgtctccggcacgctggatgtctacaaccacgacgaggagggcctccagggcgtcggggtcgaccccgacttcgcggagaaccgggccatttacctcttctacgcgcccaagctggacaccccggcgggcgacgcccccgagaacggcacggcggccgacttcgccccgttcgacgggtacaaccggctctcgcggttcacactcaacgaggacggcacgctcgacaaggcgagcgagaagaaggtcctcgacgtcaccacctcgcgcggcacctgctgccacgtgggcggcgacatcgccttcgacgcggacggcaacctgtatctgtcgaccggcgacgacaccaacccgttcgcctccgacggctacacgccgatcgacgagcgggccgaccgcaacccggcgttcgacgcccagcgttcctccggcaacaccaatgacctgcgcggcaaggtcctgcgcatcaaggtcgccgaggacggctcgtacaccatccccgagggcaacctcttcgccccgggcaccgagaagacccggcccgagatctacgccatggggttccgcaaccctttccgtatctccgtcgacaagaagacgggcatcgtctacgtcggtgactacggtcccgacgccggcgccgcgtccccgacccgcggtccggccggccaggtggagttcgcccgggtcaccgaggcgggcaacttcggatggccgtactgcacgggggacaacgacccgttcatcgactacgacttcgccaccaaggcgtccggcgcggccttcgactgcgcggcgcccaagaacacctcgccgcacaacacgggtctgacggacctcccgccggcccaggcggcctggatcccgtacgacggcggcagcctgcccgagttcggcagcggctccgagtccccgatgggcggaccggtctaccggtacgacgccgacctcgactccccggtcaagttccccgaggagtacgacggggacttcttcgccggtgagttcggccgccagtggatcaagcggatcgagcagggcgaggacggcaccgtcagcaagatcaacccgttcccgtggtccggcacccagcccatggacatggagttcggccccgacggcgcgctctacgtactcgactacggcctgtcctggttcggcggcgacgagcactccgcgctctaccgcatcgagaactccacgggcggcaagtcaccgatcgccgaggcgaccgcgaccaagacgtcgggcaagtccccgctgaaggtcaccttctcctctgcgggcaccgaggaccccgacggcgacgccctcacctacgcgtgggacttcggcgacggcggcacctcgaccgagaccagcccctcgtacacgtacaagaagaacggcacctacaccgcgcggctcaccgtcaccgacccgaccgagcgcaccgcgaccgcgtccgtacggatcgttgtcggcaacaccgcgcccaaggtgacactcgaactccccaacgacgggcacctcttcaacttcggggacaccgtccccttcaaggtgaaggtcaccgacccggaggacggggtgatcgactgctccaaggtcgtcgtccgctacatcctcggccacgacagccacggtcacccgatcacctcggccaacggctgtgagggcaccatcaccgcgcccgccgacaccgagcacgatcccaacgccaacatcttcggtgtgatcgacgccgagtacaccgacggcggaggcggcggccaggcggcgctcaccacgcacgaccagtcgcagctccagccgcgccaccggcaggccgagcacttcaacaactcctccggcatcaaggtctacgacaaggcaccggccaacggcggcaagaccgtcggcgacatcgacaacggcgactggatctccttctcgccgtacaacctgaccgggtccaagacgctcaccgcccggatctcctccggcggcgccggcggattcctggaggtacgcagcggctcggccaacggcaacctgctcggctccgcgccgatcccggtcaccggcggctgggagaccttccaggacatcgacgtaccgctccgtgccgtacccaagcagaccaccgagctgttcctggtcttcaagggcggtgccggcggcggcgcgctgtacgacctggacgacttccagctctccacggccgtgcccggcaagaccgagaagcgggtcctggtcttctccaagaccggcggcttccgccacgactcgatccccgcgggcatcgccgcgctcaaggagctcggcaagaccaccgggatcaccgtcgacgccaccgaggcggccggccagttcaccaccaacaacctggccaggtacgacgcggtggtcttcctctcgaccaccggtgacgtcctcaacgccgaccagcagaaggcgttcgagaactacgtcgccaccggcggcggctacctgggcgtccacgccgcggcggacaccgagtacgactggtccttctacggcggtctggtgggggcctacttcgactcccacccgcagatccagccggccaccgtacgcgtcgaggaccacgacaacccgtcgaccgcccacctgggcgacgagtggcagcgcaccgacgagtggtacaactaccgcaccaacccgcgggatcaggcccgcgtcctcgccaccctggacgagaccacctaccagggcggcaacatgaagggcgaccacccgatcgcctggtgccagacctacgagggcggccgtgccttctacaccggcggcggccacaccaaggagtcgtacgcggacgacgccttccgtcagcacctgctcggcggactgcggtacgcggccggccaggtgaaggcggactgcacgccgaagaccggctaccgggacctcttcaacggcaagacgctggagggctggaagcaggcgggaccgggcaagttcaacgtcgtggacggtgaactgcgctccgagggcggcatgggcctgctgtggtaccaggccaagcagctggagtcgtactccctgaagctcgactggaagatggacggggacgacaactccggtgtcttcgtgggcttcccggcctccgacgacccgtggtccgcggtcgacaaggggtatgagatacagatcgacgccaccgacgcggccgaccgcaccaccggctccgtctacggcttcaagtcggccaacatcaaggccagggaccaggttctgcggcccccgggccagtggaacaactacgagatcaaggtccagggtgagcgtctgcagatcttcctcaacggcgtgaagatcaacgacttcaccaacaaggaccccgagcgcagtctgaaggacggctacatcggcctccagaaccacggtgcggacgaccaggtgtccttccgtgacgtccagctcaaggaactgccctccgcccaccaccaccaccaccactaataagaattc

SEQ ID NO: 517 - DNA, 521 bp, Artificial Sequence
  Optimized for E.coli
ccatggcgatcgacgtgtacctgcagatcgatggtattaaaggcgaaagcaccgacaccgcgcacaaggattggattgaatgccgtagcgtgcagtgggaagtgctgcaaccgaagagcgcgaccgcgagcaccggtggcggtcacaccgcggaacgtaccgagcacaaagacatcgtggttagcaaactggcggatctggcgaccccgctgctgctgcagaactgcagcagcggtaaaaccattccgaaggcgaaattcgaatttctgcgtgcggacggtcaaggcgagcgtatcaagtatttcgagattgaactggagaacgttctgatcagcaacgtggcgccgagcgttaacgcgggtgatattctgagcgagagcctggcgctgaaatacagcaaggtgaaatggaagtatacccagcaaaaggttggcggtggcagcggtggcaacaccagcggtggctgggacctgagcgcgaacaagaccgcgcaccaccaccaccaccactaataagaattc

SEQ ID NO: 518 - DNA, 1298 bp, Artificial Sequence
  Optimized for E.coli
ccatggacaccggtagcttcagcctgctgtatgatccgggtccggcgcatgactgctatgcgctggttgtggaggatccgccggacaagaacaccaccccggatccgggtcgtaccagcagcgcgggttgcgatgcgtttgcgggtaccgaggaatttacccgtaaaagcccggaacgtccgacctgggatatcggtacctacggctggaacaccagcaactggggcaccagcccgggttatagctttaccacccagaccgcggcgaagaccgtgaccatgcgtaacgatgcgagcggtgtgtgcggtctgcatgagaccaacgttagctacacctatccggatagccaactgaaaccgggtccggaccgtgcgtaccgtaccgcggcggatggccgtatcaacgttagctatcgtgcgaagattcagcaaaccgagccgttcacctgcggtgaaaaacgtgcgctgctgaccaccgatctgatctttgaagacagcgaacatggtagcgcgcacccggatgtgatcagcgttattcactacgatccgggtaccttcaaggcgccggacagcaacggcgtggtttggtatacccgtgacgataccaccatgacctgcccggatggttgccgtgtgatggttcgtagcccggatctgatgaaagacgcgacctgggcgagcattgacgatgacttcagccagctgtttgataagtacgtggactatgttaacccggaacacctgccgaaaagcgactttgtgctgcgtggtatccaaattgttagcagcaacaccggtagcagcaccaccgcgagcgtgagcgatgttgacgcgcgtatgaccccgaacgcgccggtgcatgcgccgctgacctacggtctgaagggcagcgacggtcagagcctgtgcctggatgactataacaacgcgaccaccccgccggcggttgcggatatctgggactgcaacggtggcgatgcgcaagactggaccattggtcaggatgacaccctgcaagtgcacggcctgtgcctgggtgttagcggtgatggtaccgcggaccatgcgccggtgggtctggatcgttgcgacggtggcgcgcaccagaaatgggttctgggccgttacggtcaaatttataacccggttagcggtcgttgcctggaagtggcgaacgcgagcgatacccgtggcgacaagaacctggaactgttcgattgctggggtggcgcgcagcaaaaatggtggaccccggcgggtgactaccgtcaccaccaccaccaccactaataagaattc

SEQ ID NO: 519 - DNA, 1004 bp, Artificial Sequence
  Optimized for E.coli
ccatggatacgtggagtaacgggcatatcgtgaaaggcgctatcgaggccgaatggctgaggcttggacccgacaatgtcggctgggcagtcactgacgaactcgatgcaaactaccttggcaagttccaggtgttcgaacggccggccccgcacatgggcaactcgatctactggcataacgacacgggagcgcatcaggttggcggattgattcgcgacaagtatcgcgaccttggctgggagagtggggatctgcacttcccgactaccagcgagacccagacgccgatcaagcccggcgcgttcaaccacttccagggtgggtcaatctactactcctcgtcgaccggcgcgtggccgacttggggagcaatccgcgacacctgggcgaatgctggctgggagaacagtggatacgggttccccaagtcgtatgagtacaactgcaacgacggaatcaacccgaacgacaagtcgtggaactacggagggaagggacaggactaccaaggcggccggatcttctggaactctgcgccgaacaacttcaacctcccgtacagctcggtgcacggatcgccccgcactctgaagtacagctctacaacgaaatacacttcggcacagagcaatgcgatcagccagtggaacgcactcggtcgagtgaacatcgaaccggcgaccgtcttgaacaacgaggtcctggtcgtccgcgacatcaaccgctcagactacacatgggcggggctctacacttaccgaggggccgacttctctaccttggagatgaatgacgccaaattcaccggcccatctgacagccggatcccacgcgtgatgacccatgagtggggccactccctcggcctcgcccacagttgcgtcggctccaacatggacgagctgatctacttcaataacaacccgaacctgtctgacctcgacaaatcatcgtacaacacgaaacatccacaccaccaccaccaccactaataagaattc

SEQ ID NO: 520 - DNA, 2411 bp, Artificial Sequence
  Optimized for E.coli
ccatggcgggtcaaccggcgccggcgacctacaccgtggcggttggccgtaccggtagctacgcgtatccggacgatacccaggcgagcccgtacaccgacaaggatggtaccttctattttcagcaaagccacgcgctgtacggcgcgaaagacagccgtcagtgggatttctttaccggtcgtgacttcgatagcgcgacccgtagcagcgcgatcagcgatgcggtgaacccggcggacccgagcgatcgtaacgacgataccaccgcgcgttgcaacaacagcccgaccggtcgtcagagcagctatgcgccgcaaggtagccactatgcgcagcgtaactattgcgacctggcgggtgtgtgggttgacccggatagcggtgcgtggtacggcctggttcacaacgagttcaccccgcaaccgtttggcgatggtctgcactacgacgcgatcgattatgctgtgagcaccgaccagggtcgtacctggaccatccgtgatcacgttattaccagcccgtatagcaccgcgcgtggtgacaccgcggcgttcccgcagcaaacctttagctacggcgacggtgatcagcgtctgttcgcggacaccgcgagcggttacttctatgtgttttatggcagccgtattgttgataagggtggcagctggggcgcgtttcaacagcatgttgcgcgtgcgccgatgagcgcgaagatggcgccgggtagctggcaaaaatggtacgatggtgcgtggagccagccgggtgcgggtggcctggagagcgacatggttccggcggatggtgcgaacccgaccggttacctgccgccggcgaaagaatataacccggcgaacccgggtaccgtgagccgtcagattgcggcgggtaccctggcgccgagcaccccgctgttcgttatgaacatcagctacgacgcgtatctgggtctgtatattggtaccccgcaggcggtggatcaaagcggtaacgcgccgcagcaaatctacgcgaccaaggacctggcgacccaaaaatggaccctgctgggtgataccggtggctaccacaccgcgagctggtatcgttggtttctggacagcgcgagcctgaccggtagcaccattgtgggcaagaccttccgtagctattgcagctttgcgtgcgcgggtagcgatggccagtatgtggagctgaccgttggtagcagcgcgccggcggctccgccggttgatctgacccgtacctatcgtatccaaaacggtaacggtcgtgttctggcgcagaccgcgggtggcagcgcggttaccagcaccgcgaaggcggcgggtagcgcgcgtgagagctggcgtttcctggcggaaggcgacggtagctaccgtattgtgaacgcggcgaccggtcaactgctgggcgttgatgcgaccagcaccgcgggtcgtgcgtggggcgcggcgctgaccgcgaccggtgcggtgggtggcgacgcgaccgttggccagcaatggttcatcctgccgagcaaggcgggcaaaggtcgttttcagctggtgaaccgttacagcggtctggttattggtatgagcggtaccagcggccgtctggcggaaaccgcgccggcgcgtagctggagcgataccaccggtggcaccgtgggtggcggtcgtaccgcggcggagcaagcgctggcgctggcgccgaccggtaccgcgccggaggcggttgttctgaccgcgccgggtgatcgtagcggtaccgttggtaaagcggcgagcgttcagctgggtgcgaccgatagcgcgggcaaaccgctgaccttcaccgcgaccggtctgccggcgggtctgagcgtgagcccgagcggtctgatcaccggtaccccgaccggtccgggtgttagcaaggtgaccgttaccgcgagcagcggtaccgcgagcggtagcgcggactttacctggaccgttgagccggatctgggcggtaaccacaccctgaccaccggcggtaaagcgctggatgatgcggaccacagcaccgcggcgggtaacccgctgatcacctggaccgcgagcggcggtagcaaccaagtgtggcaatttcgtccgcaaccggatggtagctatgaactggtgaacggcctgagcagcatgtgcgcggacgttagcggcggtagcaccgatgcgggtgcgcaggttattcaatggccgtgcagcggcggtgcgaaccagcactggaacgtgcgtctgaccgcggacggtagctacagcgttaccagcgcgcacagcggtctgctgctgaccaccgcgagcggtgcggatggtgcgcgtgttacccaagaaccggataccggtagcccgctgcagcgttggagcattagccaccaccaccaccaccactaataagaattc

SEQ ID NO: 521 - DNA, 2411 bp, Artificial Sequence; identical to SEQ ID NO: 520
  Optimized for E.coli

SEQ ID NO: 522 - DNA, 2450 bp, Artificial Sequence
  Optimized for E.coli
ccatggtgcattttaagaactgcccggacccgagcctgaacgcgaacagccaaagccacccggaatttagcagcgaactggaacacatcaaggcgcgtatgcagaacttcatcaaacacagcgtgaccgatcaaaacattgaagttaccgatgcgcgtgtgaccgcggagggtgaaatcaccagcctgctgaaggagcgtctggataaggaatactttaaactgctgagcaagattacccgtgaggtgaacgttgaagacttcggtgcggtgccggatggccgtgacaacaccgaggcgtttcgtaaagcgatcggcaacggtcgtgtgaaggttaacgtgccggcgggcgaatacctggttcagggtatcaaactgccgagctggaccaccattgttggccagggtaaaggcatcaccgtgattaagctgcacgaggataccccggcgcacgaatgggttatcaccaacgacgattatcagaacggtaaccgtaacattttcgtgcaaggcatgagcctggactggaacccgagccgtcagtgcggtgttcgtaacccgggtggccaattcagcagctgcctgacctttgcgaaagttgagtacggctggatcaaggacgtggaagcgattaacgcgggtctgcacggcatcgatattaccagcccgacctatgaccacctgccggacaccgattggaccaaagatggtagccgttacatctggattgacaactgcgtgacctatggtagcggcgacgatggcatcaccacccactacagcgagtatatcttcattagcaactgccacagcggtaacccgcgtggcaccgagtttgttgaaggcgtgagcaacagcaacggtatcgaagttgacgatggcagccgtcacgtgtggctgctgaacaacttcaccagcggtaacattcgtggcgttgaggtgaaggcgcacgaactgtggccggcgagccagaacgttcacatcattggtcacgttagctaccgtgatgtgcgtgcgtttgacctgcgtcacatcggccaccaccaaattaccgatccggagagcaccaccgcgtatgatgttaccctgatcgactgcagcgcgattgaaccggtgttcaacagcctgtatgatgcggttaccccgcgtgcgctggtgatcagcgcgtataaaaacgttaacgtgagcggttttaccgcgattggcgacccggattacgactataagggtaacccggtggttgcgctgcagtaccgtagccaaaacatcaccattaacggtatcaaaattcgtggcttcaagaaagcgggtgtggatatcaacctgagcggtggcagcaacaaaaccgattacatcaagatcagcaacttcgacatctacaagagcgcgccgaagggtatcagcattggtggcggtctgtataacgttaacatcctgaacggcaccatgattaccgacaacggtaccgtgggcatccagagcccgaacaaccaagcgaccattctgggcgttcagagcgagggttacagcgtggcggcgagcatcaaaggtcaaacctatcagcaaatcccgattaacctgaagggcggtattcagctggcgaccaccagcggtttcgcggttaaccaaaccagcgcggtgatcgcgggtaccggcgatattaccgcgcgtggtgagcgtaacgcggtgatcagcagcagcggcggtagcagcaccgaaggtagccgtgcgctgatcgcgagcagcaacaacgcgcacattaaaggcaaccacgttagccgtaccatcctgagcagcgaaaacatcattctggaggaaccgtacaccgttgcgggcggtcaccagagcatgaagtggctgctggacagcgtgcgtggtaacggcacctttgcgggtgcgatcagcagcagcctgggcggttacggcgagtattttgaaagcagcaccggtcagctgatccacaccggcaccattgttaccctgcgtggtgagaagattgcgccggcggatgttggcgactacatgctgggtgtgatcagcgaaaccagcgcgttcattagcggtgcgagcagctttgtgtggcagggccgttacctgaccaacgagttcggcggttttatctatgaagtggttaccgacgaggaaagcggtgaactgattcgtgttccgaaacaaaacccggattacgacaccgcgctggaggcgaactatcacagccgtgcggcgcgtgatgaatggcacgtggttggtctggttggcaagcactacgtgcgtatcgacgagaccgtgagccagggtaactatctgaccgcgcacaacggtattggcaccaaagcggcggaaggcagctggaaggttatgaaaatcaccagcgcgtacaccagcgagaagggctatggcattgcgctgaccgttatcaagcaccaccaccaccaccactaataagaattc

SEQ ID NO: 523 - DNA, 1823 bp, Artificial Sequence
  Optimized for E.coli
ccatgggccaggacatcagcggtagccaaggcagcaccaccaacgagttcaacccgtggagcccgcagaacggtcacccgtatcgtcacggcgcggtgccgggtatgagccagcacgaaaactataagaaatggctggcggcgcacaaccaggcggcggcgaccggtcagcaaaccctgagctacggtggcggtgtggatggtattggcgttcaaagcggtcacagcaaggtgtacctggtgttctacggcaaccaatggggtacccaaaccaccgatgcgggcggtaacgcgaagttcagcaacgatagcgcgggtgcggcgggtgcgacccagcaaatgtttaaaggtatcggcaccaacggcgagacctggagcgcggacctgacccaatggtgcgatggtccgaacgtggcgaccggtgcggttagctgcccgagcaacgcgaacttcattccgtatcagagcggcggtgtgctgagcggcgtttggtacgacaacgcggcggcgagcccgagccaagcgagcggtaaccagctggcgcaagaagcggtgaaagcggcgggtcactttggcaacaccaccgcggcggcgaaccgtgatgcgtactatatcgttctgagcccgcacggtaccaacccggacgattaccagaacccgaccaccggctattgcgcgtggcacgactggaacggtgataccaccctgaccggcggtgcggcgagcagcccgtatggtgacatcgcgttcagcaaccaaccgtataacattgatgcgggtagcaactgcggtgtgggctttgttaacagcccgggcaccctggacggttggaccatgaccctgggtcacgagtggcacgaaatgatgagcgatcagaacccggcgggcggttggaccaaccatgtgagcggcagcagctacaacggtcaggagaacagcgacgaatgcgcgtggattcaaccgggtagcaccggcggtgcggcgaacattagcttcggtgcgtttggcagctatgcggagcaggcgagctggagcaacgataccaacagctgcgcgatcagccacgcgattctgacccacggcaacgcggtgaccgttaccagcccgggtaaccaaagcggtaccgtgggtaccgcggttagcctgcagattaacgcgaccgacagcgcgaccggtcaaaccctgggttacagcgcgaccggtctgccggcgggtctgagcatcaacgcgagcaccggtctgattagcggtaccccgaccgcggcgggtaccagcagcgtgaccgttaccgcgaccgataccaccggtgcggcgggtagcaccacctttacctggaccgagagcaccggcggtggcggtggcaatgcgatcaccaacggtggcctggaaaccggtagcctgaccggttggaccaccgttggtagcaccagcgcgaccgcgccggcggcgcacagcggtggctacggtgcgatggttggtagcaccggtccgaccggtgacagcagcattgcgcaaacctttaccgcgccgaccggtaccagcaagctgagcttttggtacagcaacacctgcgacgataccgttacctatgactgggcgaccgcgaccctgaaagataacaccaccggtaccaccaccaccgtgctggcgaagacctgcaccaccaccggcacctggaccaacaaaaccgcgaccgttaccccgggtcacagctataccctgaccctgagcaaccacgacgataactacccgggtgacccgacctatacctactatgacgatgtgaccgttagccaccaccaccaccaccactaataagaattc

SEQ ID NO: 524 - DNA, 1199 bp, Artificial Sequence
  Optimized for E.coli
ccatgggtaagagcgcggcgaccacccaggttgaaccgggtggcgcgtgcaccgcggcggacctgggcacccgtcacccgtacatcaagaccaccgaggttaccccgaccattacccacttcaaaggttggtacgttaccgaaggcaccaccggtagccagaccatcaccaccagcacccaaaccaccattagcgtgagcgttggcctgaacggtaccgtgcagggtagctttgcggttgagaccctgggtaccgtgggtgcgagcctgggtctgaacgtgcaagttacctacagcagcaccagcagcgaaagcaacagcgttacctggaactttaaccgtccgggctactatggtgtttacaagggtaccaagaaagtgaccggcacctatggtagcctgaactgcaaccgtgtgcagcaaggcgatgcgagctgggcgctgaaatggaccgagggtgcgggcagcggtagctttaccacctataccgcgctggaggaaggtgctgttcgttgcgaggacgaagtgccggcgaacagcattatggcgaccgcgcaaggtctgctggattgcggtagcgcggcggcgaaggcggaacatccggcgggtgcggtggcgccggcggcgaaacagctgcgtgaccgtctggttcaacgtccggcgctgaccgtgggtaccagcgcggaacaaccgaaagcgaccggtcgtagcgcgcgtagcgcgctgaactgcggtaccgatgcgtacaagattgcggttccgggtaaaccgctgagctggggtgcgccgctgctggcggatgatggtgtgcgtctgcgtccgagcaccattttcagcgcgcacctggacaactggcgtctgtgcgatgttaccgagaacaacggtgtgctggaagcgagcctgtggaactggggtaacggtcgttgcgcggcgattgcggagcagaacgcggcgaccgagggtgcggttctgatgaccgcgccgtgcaccgaggatgatctgcagcgtttctacatctatcgtgacgttccgggcagcagcatgattggtgtgcaaaacaaatacaccggcagcatgatgggtcacgaccgttacgcggatggcgaatttattcgtcagtatagcagcggtcgtcaagatggcaccggtacctataccctgaccggtgtgcaccaccaccaccaccactaataagaattc

SEQ ID NO: 525 - DNA, 4253 bp, Artificial Sequence
  Optimized for E.coli
ccatggatagcagcggtccggtgccgggtaacccgacccagagcgcgctgctgcaggcgcaagcgaccgacaaaccggtgccggttgatagcctgaccagccaaacgaccaccaccaccgcgaacccggatggtagcctgaccaccaccgagtacgttcaaccggtgcgtgttatgaaggacgatgcgtggaccgcggtggatgcgagcctggttaaaaacgcggatggtagcctgagcccggcggcgaccccgaacgatgcgaccctgagcggtggcggtagcggtccgctggttagcctgaccgatccggcgggtcgtggtctgagcctgagcgtgccgttcaccctgccggcgccgaccgttagcggtaacaccgcgacctatgcgagcgtgctgccgggtgttgacctggaagcgaccatcagcgaccagggcggttttagcgatgtgctgattgttcacgatgcgaccgcggcggcgaacccggatctgcgtcgtctgaccctggcggcgaccacccagggtctgaccctggcgggtagcgcggatggcggtatgaccgcgagcgcggcggatggtaccaccgcgtacaccgcgagcgcgccgatcatgtgggacagcaccaccaccaccgcgggtccgcagccggcgagcatgcacctggacgatgcgaccagcaccaccccgccgccgccggatggtccggcgccgggcgcggacgtggcgccggttaccatgaccaccaccagcaacagcctgaccctgaccccggacaacagcatgctgaccggtaccggtaccacctggccggtgtatatcgatccgggcgttctgccgagcgagaccaccaaccactacttcgaagcgcagcacggttgcaacagcagcagcgcgagcagccacgagtacgactatccgcagcgttttggcgaaggtgttggctaccaacgttatgcgagcagcaacggtgattgcattggcgcggagcgtgcgttctatcaactggataccagcaacctgaacagcagcatggacatcattaagagcgaactgcacctgaccgagacctacgcggaagcgtacggttgcacccacaccgcgccgctgaccctgaaatggaccggcggtatcagcagcggcatgtactgggacacccagccgagcgtggttagcaccattgcgaccaagaacccgagcagcgcgtacaacggtgcgtatgcgagccagccgaccagctgcggtgatcaagacgtggttttcaccgtgaccgacaagatcgcgaaaattgcgagcgataacgacagcacctggaccgttggtctgtacggcgatgaggacagcagcagcagcaacatcgattttatgcgttacagcaccaacccgtatatccaaaccacctacgatattccgccggacaccccgaccagcgaaaccaccaccccggatgcgcacaacccgagcggtgcgaactgcggtagcagcacccgtggttggattggtcagaccaccctgaacggcaacaccagcgacattaccctgaacgcgaaactgaccagcaacgtgaagggcgagaacgttaaagcggattacaccgtgtgggacgatcaaaccgcgaacagcagcggtaacgcggcgaccgttgcgaccccgagcagcagctatgtggcgagcggcaccaccgttcacatcagcattggtaccaccgtggaagacggtcaccagtacggctggcaagttcgtgcgtatgatggcaccctgtacagcagctggaacagcccgtgcggtttcaaagtggatctgaccccgccgagccagccgagcgtgaccgcgccgagcgcggtttttccgccggcgggtagcaaccaggcgccgaccggttatgcgggtcaaaccagcaccatcaccgttaccagcagcgacccgaccccgaccggttgcacccgtggcacctgcctgagcagcgatgtgtggcgtttctgctatgcgctggacgtgcaaccggcggttaactgcccggattacgttaccgcgaccaccaacagcagcggtaccccgagcgcgagcattccgctggacccgaccacctggggtacccacaccctgtatgtggaggcgcaggatcacgcgggtaacacccaagcgctgccgaccacctacaccttttatgcgccgtggaacccggcgaccaaagtggcggcgggtgatctgagcggtgacggcgttccggatctgctgggcaccaccaaaaacggtgacctgaccctgctgccgggtaacaccgatccgggtaacagcccgaccctggcgagcaccgcgagccagagcccggatggcaagaccagctggaacgactacctgatcacccaccgtggcagcattaaacaagacggtctggacgacctgttcgcgaagaacagccacaacctgtacgtttataaaaacgatggtgcgatcagcagcggtaccccgggtcactttaccaacaccgcggatgtgtatggtccgctggacaaaccgcagtgcctgccgaccgcggacaacgcgaccaactgcgttacctacaacgcggcggattggagcagcgtgacccaaatgattgcgccgggtgatgtttacggtaccggctatccggacctgatcaccattgaaaacaagcagctgtggctgtataaaggcagcgcgcaagatagcagctactttggtccggcgaccggcggtaccaccagcaccaccccggtgctgctgggtaccggtgattggagccactttaccctgattgcgccgggtaccgttaacagcaccccggcgctgtgggcgcgtgacaacaacaccggcaccctgtacaccttcccgctgaccgcggatagcaacggtctgccgccgctgctgaccgcgccgaccagcagcgcgctgaccagcggtctgaccgcggcggacggtaccagcctgtgcgcggatgatagccatgcggcgacccagaacggcaacaaaatccaaatttggggttgcaacaacacccatgcgcagagctggaccccggcggcggacggcagcatccgtgtgctgggcaagtgcctggatgttacccacggcggtaccaccgatggtaccctgattgatctgtggacctgcaacggtaccggcgcgcagcaatggaagctgggtagcaaccacagcctgctgaacccgggtagcggcaaatgcctggacgatccgaacagcagcaccaccaacggtacccagctgcaactgcacacctgcaacggtaccggtgcgcagagctggaccagcagcaccccgagcaactgggcgagcgatgcggcgaccgcgctgccggtgaccctggcggcgagcgattatccgaccgttgcgagcccgggtaacctgaacggtaccaccgcgggttatccggcgctgtatgcgaccaccagcgcgggcgagctgatcgaatatccgggtgcggcgccggacaccaacggtaccgcgacctttggtagcccggtgaccgttggctactataacaccgcgaacgcggcgtggccgctgaacgacgataccgaccgtaccgcggcggatagcattggcaccaacgatgcgaccctgaacggtgcggcggcgtggaccagcgacagcacccgtggtaccgtgctgagcctggatggtaccaccggctacgcgcagagcaccagcagcgcgctgccgaccggtacccacaccgatccgaccgacggtaccaccaccgacaacaacagcttcagcgtgagcgcgtgggttaaactgaacagcctgaccaacaacagcacctttgtgagccaaagcgacagcaccggcaacgcgaacgcgtatcagctgtactatagcagcggtagccaaaagtgggcgttcgatcgtcacgacgatgacaccaccggtaccaactttaccgcggtttacggcgcgaaagcgaccaccggtacctggacccacctggtgggcgtttatgacggtccgaccaacaccctgaacctgtacgtgaacggcaccctgaccgcgaccaagacctttgcgggtaccccgtggaacgcgaccggtccggttcagattggtcgtcgtctgtatcaaggtacctacggcgagtatgcgaacgcggatatcagcgacattcagctgtacaacaccgcgctgccgccgagcgaaattagcgcgctggattatgaccagaccccgtacacccaactgagccaccaccaccaccaccactaataagaattc

SEQ ID NO: 526 - DNA, 6068 bp, Artificial Sequence
  Optimized for E.coli
ccatggcggagaatccgtgggttccgccgcagcaactggcgggcgagcgtaacattatcacctggaatatgcaaggcagcaccgcggttgaaaccggtagcacctacgaacgtctgaaccagctgtacagccgtgcggttgcggatgcggcgcgtggtgcgggcctggtggaacaaaaacgtgtggttatggcgctgcaggaagcgggtgtgccgccgaccagctgggcgccgctgcaagcggcggagctgccgaacctggtggttccggatggtgttcgtggctacaagcgtcgtgtgggtcgtgactacacctacctgttccatgcgcagaccattggtgatgatccggcgggccgtgttaacagcgcgattatgaccaacgaactgccgcgtcgtctggtttatattccggcggtggcgggtaccctgcgtccgctgattggtgtgggctacggtgaagaccgtgcgaacggcgagtactatttcagctttcacgcgagcagcggtaacggtggccgtgatatcgttccgatgctgcgtcgtctggtggcggaaatgggccgtctggaggcggatgagcatgaaggtcacgcggttaactggtacgtgggtggcgatttcaacctggacccgaccaccctgcgtgatcgtctggacggtccggaagttaacggccaagatgtgcacatcgcgcgtccggagcgttatacccaccgtagcccggatggtaccaccagcatgctggactacgtggttaccaacgatccgagcatgagcgacgttctgggccgtgtgaccgaccagaccggttatgcggaccacgataccgtttactatggccgtcgtattggtggcggtgcgccgtgcgcgcgtccgcgtgtggcgggtctggaagcggcggcgccggaggcgagcgcggatccgtgcccgctgccgcgtccgggtgcgattgtgagcatgggtgacagctatattagcggtgaaggcggtcgttgggcgggtaacgcgctgaccaaacaagagggtgatgtttggggtaccgaccgtcgtagcaagtgcccggatggcagccaggactgcgtgtacggtgcgaccagctatgacaacaaaggcaaccgttgcgatcgtagcgacgttgcgccgattaagggtgcggagtttgaagatatcccggtggagcgtcgtctgaacattgcgtgcagcggtgcgaccaccaaagacatcctgaccgaaagccgtaacaacgagaagccgcagattcagcaactggcggatctggcgcgtacctacgacattcgtatggtggttgtgagcatcggcggtaacgacctggatttcagcggtatcgttagcgattgcgcgaaagcgtactatcgttgggtggaaatttgcagcgcgccgaacaaagcggcgcgtgttgcgcgtagcgttgatgcggtgcaggcggagattgtgaaaaccctggcggcgatccgtagcaccatgaccgcggcgggccagagcggttaccaactggttctgcagagctatccgaacccgatcccggcggcggataacttccgttacccgtttgatggtaccagcgacccgcgtttccgtcagggcggttgcccgtttaccgacccggatgcggactgggcgcacagcaccctggttccgaaaattagcgacatgctgcgtcgtgcggcgggtaccgcgggtgcgaagttcctggatgtgcaagacgcgtttgcgggccacgaactgtgcgcgaagggtgcggaacaagcgaccgaggcgaacagcaacgcgagcccgctgccggcgagcaaggcggagtgggttcgttgggtgccgtatattccgaacctgggttggctgaccccgaacgcgcaaggtgatgtgcaggaagcgattcacccgaacgcgttcggtcagcaagcgctgagccagtgcctgaccggctttggtaaagaggcgccggcgagcgaccgttacatcttcacctgcaccggcagcggtgatggcatgaaggttgtgccggacggtagcgcggttcgtgaaggcattgtgcgtctgcgtaacgcggaaaccggtgaggttctggatgcgcagggtaacggcaccgacgattatctggtgacccgtccggacaaagcggaagcgagccagcgttggctgctgcgtaacgttggcgagaaggtgaccctgcaggcgcaacacaacggtcgttacctgaacctgtggcaccacctgctgagcggtcgtaactgggcggcgctgggtgacaaagaaaccggctggtttcacagcgcgcgtgaggatggtcgtgttgcgctgagcctggacgatgtggacatgaccaccggctgcctgacccaagatccgggtcgtcgtagcgaagacaccaactgggttggtgtggatagctgcggtcaaggcgttaagaaagagcagtactggtatatcgattacccggacgatgttgtgattaccccgcgtcaaccggatgcgggtaccgacccgcgtgaaggccagcaagttgagctgcgtagcgcggcgggtaccgcggttcatctgagcggcggtagcaccgaagcgggtaccagcgttcaagcggcggagccggatggtagcggtgcgcagcgttgggtgatgcgtagcctgggcggtggcaactggcgtattgcggcgagcgcgaaaccggatatggttgtggaccacaacccgggtccgcacaccacccacctggttcaggcggaggaaggcaacgcgaaccaagtgtggcaaccgaagggtgcgggtggcggttggtacaccctggttagcagcgcggatggcggttgcctgaccggcggtggcgcgggtgaagcgctggcggtgaccgcgtgcgacgcgaacaaccaggcgcaacgttggaaattccgtgaaaccggtaccggcacccaggttggtaccatccgtggtctggagggtaaatgcgttgagccgcgtggtggcagccgtgatgatcgtaccccggttgcgctggcggattgcgcgggtagcgatgcgcaagcgtggaccgtgagcgacgatggtagcctgcaaagcctggcgaagtgcctgcaggttgatggtggccgtgcggacaaccgtaccgcggtgcagctgtatacctgcaacggcagcccggcgcaaaaatggatctacaccgcgcgtcaggagctgcgtaacccgaacagcggcaagtgcctggatgttccggatagcgacaccagccgtccgctgcaaatttacgattgcaaccgtcgtgacagccagaaatggcaactgagcgcgcgtccggtgggtcagccggatggtggcgacgcgggtgatccgtttgatgcggcgccggatgatcgtggtaccaaaccggcggcgagcggtgactgccgtccggagggtatggcggttaccccgggtgtggcggcgcgttactgcgatgtttatgacggtgcgggccgtgagtgggtgggtaacaaccgtacccgtcgtgttgtgggttattttaccggttggcgtgcgggtgcgagcggcgatccgaaatacctggcgagcaacatcccgtggagcaaggttacccacgtgaactacgcgttcgcggaagttcgtgacaaccgtatcagcattggtgatccgaacgacccggcgaacccggcgaccggtatgacctggccgggcgagaaaaacgcgatggacgcgagcctgccgtacaagggccacttcaacctgctgaacacctataagaaaaagcacccggcggttaaaaccctgattagcgtgggtggctgggcgggtacccgtaacttttatgcgatgaccaccaacgcggatggcagcgttaaccaggcgggcatcgatgcgttcgcggacagcgtgaccgatttcctggaccgttacggttttaacggcgttgatattgactacgaatatccgaccgcgctgccggacaccggtaacccgctggattgggacgtgagcaacccgcgtcgtaaaggtctgcagcaaggctacaacgcgctgatgaagagcctgcgtgagcgtctggatcgtgcgggtaccgacaagggccgttactatctgctgaccagcgcgggtagcagcagcggttatctggttcgtggtctggatgcgggccaagcgctgcagtaccaagattatgttgacgtgatgacctacgacctgcacggcagctggaaccgttttgtgggtccgcaggcgccgctgtatgacgatggccgtgataacgaactggcggacgcgggtatctacaacgatcaagcgccggataccaaagacttccagaaagagggttactttaacgttgactgggcgtatcattattatcgtggtgcgctgccggcgggtcgtatcaacctgggtattccgtactatagccgtggttggcgtgatgtgcaaggtggcaccgacggtctgtggggtaccgcggcgatgccggaccaggcgcaatgcccgctgggcaccggtggccgtggtccggcgaacgcgcagagctgcggtaccggtgcggttggtatcgataacgtgtggcacgacctggagaacgaacgtgaggttggtgcgggtagcaacccgctgtggcacaccaaaaacctgcaggatggtcgtaccccgggctacctgcgtagctatggtgtggacaccaacctgccgagcggtcaactgaccggcacctacgcggagaagtatagcgatgcgctgcagagcccgtggctgtggaacgacgcgaaaaaggtttttctgagcaccgaaaacgagaaaagcctggatgcgaaggcgcgttatatcgtggacaaaggcattggtggcgcgatgatctgggaactggcgggtgactatgcgcaacgtccgggtggcgagtggggtatgggctacgatctgaccacccgtctggacaacgcgttcaagggtgcgggcgcgaccggcaacaccaaagcgggtggccgtccgcagccggcggaagttatcgacgtgaaggcggagctggttgacttcccgaccggtgaaaaagacttttacccggttcaaccgaagctgcgtatcaccaacaacagcggcgtgaccctggcgcagggtaccgaaattgcgctggacctgccgaccagcatgccgccagttgtgaaagataacgactataaagagatgaaaggcctggttccgggtcataccggtccgaacaccggtggcctgaagggtgattttcaccgtctgaccctgaccctgggttactgcgaagacctggcgccgggtaaaagccgtgatatcgacctgaagtactatctgccgattaccggtccgagcaacgttaccttccgtatcggtggccgtgagtacggtagcaccggcgatcaacgtcgtgacgttcgtaccgtgaccccgccggcgccggcggcgggtagcagctgccaggcgccggattggaaacagggtcaagtttatcgtccggatggtggccgtctgtggcgtatgtatgataaaggtgacaagggctggatgtttgagtatggtgacagcccggcgggcaagccgatgatgattgataacaacccggaccaaagccgtgcgcacctggtggaactgatggagcaaaacgcgaaccagtattggcgtatccagccggcgggtggcggtctgtacaccattgcgggcggtggccgttgcctgaccgcgaccgcgagccgtcaagatctggcgagcgttggttgcgatggccgtccggaacagaaatggcgtctggtgccgattgcggacaacggtagcgagggtgcgccgggtggcccgaaacacaacggcctgtttaaactgcgcagcgcggcgggtagcgatattgaactggcgggtggcgcgaccgcgcgtgaaacccacctgctgaccggcgacccggcggcgagcaccgcggcgttcgttaagtaccaaggtagctactggtatgcgcagtggtataccaccgtggcgccgggcaccgcggaagcgaatggcggtcgtccgtggaaaaaactgagcccggcgccgcaccaccaccaccaccactaataagaattc

SEQ ID NO: 527 - DNA, 7757 bp, Artificial Sequence
  Optimized for E.coli
ccatgggtcagggcgtgccggaataccactatgatggcaagctgtggagcgcgggtccgacctataaaaccccgagcgttggtggccacccgctggcgggtcgtaccccggcgaccccgaagaccaccaaaccgctgcgtacctatcgtccggcgcgtccggcgtggccgagcgcgggtaccagcaccattgcgctgacccagagcgcgaaaagcagcgcgaccaccagcaccccgcagcaccaaaccgcggatggtccggcgaccagcccggtgcgtgcgggcaagctgccggtgtgggttgcgccggcgaaacaagcggcgaagaaacgtggcgcggcgccgagcaccccggcggcggtgcgtgttcaactggcgggtcatgcgcaggcgcaagcggcgggcgttgatggtatgttgctgggcctggcgcgtgcggatggtgcggcgagcagcggccgtgtggcggttaccctggattacagcgcgctggacaaggcgtatggtggcggttttgcgagccgtctgcacctggtgagcgttccgggttgcattctgaccgcgccgcagaaaccgagctgccgtgtgcgtaccccgctggcgagcaccaacaacccggttgcgcgtaaactgaccgcgaccctgaacctgccgcgtccgaccaccagcggtgcggcgggcgcgagcgcgcatgcgggcggtaccgcgggtagcgcgagcgtggcgccgatgaccgcggttgaagcgattagcggtgcgagcggcagccagggcgactataccgcgaccagcctgaacccgagcggtagctggagcgcgaacggtaccggtgcgttcacctacagctatccggtggcggttccgccgagcctgggcggtgcggcgccgagcgtggcgtttagctacgatagccagagcgaggacggtgaaaccagcgcgcgtaacagccaaagcagctggatcggtgacggctggagctatagcccgggcttcattgaacgtagctacaagccgtgcaaacaggatggtattagcgacagcgcggatctgtgctggggcggttggctggcgaccctgagcctgggcggtcacagcggtaccctggttcgtgatgaaagcggtaacccggacaccccgaccgcgaaccagacctggcacctgcaaggtgacgatggcaccaaaattgaggaactgggcggtgcggacaacggtctgtggaacggcgaatacttcaaggtgaccaccaccgatggcaccgcgtactattttggtctgaaccatgcgccgggtaccaccagcgatgcggcgaccaacagcgcgtggggtgagccggtttatagcccgaagagcggcgatccgtgctacgacagcggtcagggcaaagatagccaatgcacgatgggttatcgtttcaacctggattttgtggttgacccgcacaccaacgtgcagcgttacacctatgcgaccgaaaccaaccactacgatcgtggcggtggccaagttgcggcgagcggtggcagcggtaccctgaccaaatacgttcgtggtggctatctgaccgagatcgattacggctatcagctgaccgatgaaaccgcgggtagcaagccgggtgcgcgtgttctgttcaaaaccgcgcagcgttgccaaaccagcagcacctttaccgattgcagctatgcgaacctgaacgacaagaccgcgaccaactggccggatgtgccgtacgacctgaactgcgcgagcaccgacaccaccagcggtaccggcagcaacgtttgcctgaccaccgcgccgagcttctggagcaccgaccgtctggatagcgtggttacccaggtgaacgttggtggcaccctgaccgacgtggatacctaccagctgacccaaacctatagcgatgcgggtggcaccgtggacccggttaccggtcaaagcggcaaagacgcggcggatgagggtgaactgcagagcgtgatgtggctgagcagcatccaacacaccggcgacgataccaccggtggcggtagcaccagcccgattaccctgccgaaggttaccttcctgggtaccgagatcgataaccgtattgacggcggtaacgaaccggcgctgtttcacccgcgtatgagcagcgtgaccaccgagaccggtgaaagcatcgcggttacctacagcgacccggattgcagccgtctgaaccataccatgccgagcgcgccggatgcggataccatgagctgctacaacgtgtattggaccattccgggcggtgtgaccccggttagcgactggttcaacaagacccgtgtgaaaaccgtgaccgttagcgatggtaccggtaccggtagcccggcgcaagttagcaactacacctatagcggtccggcgtggcaccgtgatgatagcgaactgaccgacgatacctatcgtacctgggaccaatttcgtggctaccgtaccgtgaccgttaccaccggtgcgggtagcgatccgatcacccagaaaaccaccacctacctgcaaggcatggacggcgatgttcgtgcggacggtagcaagcgtagcgtgagcgttaccgatagcgtgggtgacaccgttaccgacagcgattggctgagcggtaccccgctggaagcggacacctacacccaggcgggcggtagcgtggttgcgaaacagatcgatctgccgcaaacctttaccaccaccgcgacccataacgcgggtagcagcctgccggcggtggttgcgcgtatgattaagaccagccagcaacgtacctatggtctgctggcggatggtagctggcgtgaggcggaaaccgataccagctacaacggtgatgcgctgccgaccaccgtggatgcgaagggcgacgtgagcgttgcgagccaggaaaaatgcgcgaccaccagctatgcgaccccgccgagcggtaacccgatgatgctgagctatccggatgaggtgctgaccgttgcgggtccgtgcagcaccaccccgggtaccagcaccaccgttagcgataaacgtatgttctacgacggcgatggtaccgtgaccaacgttggtacctttggtcatctgggtaccaccggtgacctgaccgcgacccagatcattaccggttacagcagcggtgcgccgacctatcgtaccacccaagcgaccgcgtacgatatctatggtcgtgcgattcaggtgcaagacgcggatagcaacaccaccaaaaccgcgttcaccccgaccaccggtcagctgccgacccaactggtgaccaccaacccgcgtacctggaccaccaccagcgttatggacccgctgcgtggtctgaccatgaccagcaccgatccgaacggccgtaccaccaccatcgactatgatgcgctgggtcgtcgtaccgcgatgtggctgccgggtcgtccgaccagccagagcgcgagccgcacctttacctacgcggttaacgacaccgcgccgaccaccattaccaccaacaccctgcgtgacgatagcaactacagcaccgcgatcgacatttatgatggtatgctgcagctgcgtcagacccaaagcaccaccgcgaacaaccaagcgggccgtctgatcagcgataccttctacgacagccacggttgggcgcgtaaaaccaacagcacctactatgaaagcagcaccagcccgaccaacaccatgtgggtggcggacgataaccaggttccgagccagcaagtgaccgttcatgatggtctgggtcgtaccaccgcgacccaactgtggagcaaaggtgcgcagcgttggcaaagcaccaccgcgtatccgggtgtggatcgtaccgataccaccccgccgagcggcggtaccgcgaccagcagcttcaccaacgcgctgggtcagaccaccgcgacctggatgtacgacgataccgcgaccccgaccggtaaagcgagcgatgcggtggttaccggttacacctataccccggcgggtcaagttgcgaccatgagcgacaacgcgggtaacaagtggacctacagctatgatctgctgggccaggagaccaaacaaaccgacccggataccggtaccaccaccttcgacaagtatgacgatctgggtaacctgctgcaggcgaccgatgcgcgtggtcaaattctgagctacgcgtatgacaccctggatcgtaaaaccgcggaatatagcggtgcgtggagcgcgaccccggacccgagcaacgagctggcgagctttaactacgataccctggcgaagggttacccgaccagcgcgacccgttatgtgggcggtgcgggcggtgacgcgtacacccaggcggttaccggttacaccaccgattatcaaccgaccggcggtagcaccaccatcccgaccagcaccggtttcccgagcaacagcaccggtaccaacagcaacacctataccgtgaaataccactataccccgattatgggtctgctgagcgaagcggattatggtgcggatggcggtctgccggcggagaccctgggctacggttatgatctgcagggtctgctggacggcttcggcggtaacggcacctacctggacaccaccgattataccccgctgggtcaggtgaaggacacccgttggggtctgtatggcgagcaagttgaaccgacctttagctacgacgataccaccggtcgtgtgacccagagccaagttaacctgcagaccagcgcgaccagcgcgctggatgttaccgattaccgttataaccaagcgggtgatgttaccgcggtgagcgacacccagagcggcggtaccaccgatacccaatgcttcacctacgaccacctgaaccgtctgaccaccgcgtggaccgacaccgcgggtctgaccagcgcgggcgtgggtagcaccggcgcgtgcaccaccagcaccccgctggcttctaccaccggcggtccggcgccgtactggcagagctacacctataacgcgctgggcgatcgtacccagcaagttcagcacgacaccgcgggtaacaccgcgaacgatatcacccaaaccgcgacctatccgggtagcggtaccaccccggcgaccctggcgaacgcggcgaccaaaattaccaccaccggtccggcgggtaccgcgaccatgaccccggcgtacaacggtgcgggtgataccaccggtcgtaccgtgaccaccgcgggtccgctggttagcggtcagacccgtagcggtaccaaactgtgcgcggacgatagcagcagcggtaccaccgatggcaacaagatcgacctgtatacctgcaacggtagcaccgcgcagcaatggaccattgacaccgatggtaccgtgcgtgttctgggtaaatgcctggatgcgagcggcggtggcaccaccaacggtaccaagatcgatctgtacacctgcaacaagagcgcggaacagcaatggaaagcgggtgcgaacggtagcctggtgaacccggcgagcggcaagtgcctggacgatccgagcgcgagcaccaccaacggtacccagctgcaaatttggacctgcaacggtaccccggcgcagcgttggaccaacgcgacgatgggtaccgtgctgccgggtgcgacccaggcgctgggttatgatgcggagggtcgtaccgcgagcgttaccaccccgagcggtggcaaaaaccagaccaccagctacctgtatgatgcgggtggcagcctgctgctgcaaaccaccccgaccagcaagatcctgtacctgttcggtggcgcggaacagctgaccctgagcaccagcggtggcaccgtgaccggtcaacgttactatccgggtccggacggcattaccgaggtgcgcagcagcgcgggtaccctgacctacgaagttagcaacgcgcaaggtaccgcgaccgaaagcctggcggcgagcaacctggcggttacccgtcgttacttcgatccgtatggtaacccgcgtggtccgcaaccgaccacctggaccgacaaccacggttatctgggtaaaccggcggatccgaccaccggtctgaacctgctgggtgcgcgtgactacgatccggttcagggtcgttttctgaccgcggatccgctgatggaggcgggtgacccgaaccaaatgagcggctacagctatgcggcggataacccgagcaccggtagcgacccgaccggtctgcacctggcgtgcggcgacggtgacgatccgccgtgcccgagcggtggcggtgcgagcatcggcggtatgggcggtagcagcaccaccggcggtggcggtggcggtggcggtggcaccaccaccagcagcggtggcaccgcggcggcgccgagcgcgggtccggcgtgcaacgtggcgagcaagttcggctgcgacgtggttgatgcgcagcaaatggcggataacggtccgccgaccagcggtaccctgcgtgatttcatcgcgggtgcgctggacgagtttgttcaccagctggaacaactgaacccgggttgggcgatgggcaacgtgccgcacgacgttgcgaacggtatggcgccgggtattgcgggcccgccgcgttatgtggaaccgcgtcacgtggttgcgcacaccgttcacgcgcacaccaacaccgatgcgtacaaaggtggcgaggcgaccaccgtgctgctggaatttgcggcgagcggtggcgacgatgcgccggaagcggctgtgagcgcggttgcggatgcgggtgatgcgcaggacggtctggcggcggcggcggaagtgaagaacgtggttagccaaaccaccggcgaggcgaccgcgaccgcggcgaccccgagcgaaccggcgaccggcgcgagcggcaccggtgaaggtccgtgcagcttcagcccgagcacccgtgtgctgctggcgcagggcaaaaccaaggcgattgcggcggtgcgtccgggtgacaaagttgaagcggcggacccggataccggtcgtcaccgtggtccgcgtaccgtgcaacacgtttggatcaaccacgaccacgatctgctggacgtgaccattcgtaccaagggtgatcacaccgcgaccctgcacaccaccgcgaaccacccgttttgggacgataccacccatcgttgggttccggcgggcaagctgcaccacggtgatgcgctgaaaaccagcagcaacggccacgcgtacattgttgcgagccatgcgaccccgggtaccgcgaaacgttggaacctggcggttcagcaactgcacacctactatgtggttgcgggtggcgtgagcatcctggttcacaacagcaacggtccggacagctgcccggtgctgggtgcggcgcgtgcggcggcggataccgcgagcgcgattaccccgggtaaagcgcgtccggcggttgcggaagcgctgcagctgccgggtggccaaatctacagcagcccgagcattcgtggtgtggcgccggagctgcacagcgatgttcaggcgatcctggacgatattccggagggtgaacgtggtgttggccacggtcgttgcggtctggcggtgtgcgttagcgatgcgctgagcgacggctttaacccgaccggtagccgtgcggcggcggtgattgttcgtagcagcaccgacaacccgatgcatggtatgccggtgggtccgtgcgatagctgcgttgcgctggaggatgcgttcgacatccgttttgaaggcattggtcaccaccaccaccaccactaataagaattc

SEQ ID NO: 528 - DNA, 7739 bp, Artificial Sequence
  Optimized for E.coli
ccatgggtaagctgccgccggttcagcacattgagccggtgccgctgacccgtgttgttgcggaacaaccggcggcgaaagcggcgcaaccgaaaaccgctccgccggtggcggcgtggccgaaaccgggtcaagcggatgttgatctgccgccgagccgtgcgcaaaacccgagcccgcaagcgaaagcgccgggtctgccgctgaccattaccagcaccggtgcgaacccggcggcgggcgagcaggcgaaagtgcgtgtggcgctgagcgatcgcgcggcggcggcgaaagtgggtctggatggtgtgctggttaacctggaaccggttgcgggtagcaccaccccggacaaggcgcgtgttcagctggattacaaagcgttccgtgagagctttggcgcggattggggtagccgtctgaccttcgtgcaactgccggaatgcgcgctgaccaccccggaccaaccgcaatgccgtaccgcgaccccggttgcggcgagcaacgataccaaggcgggtaccctgaccgcggatgtggcggttgcggcgccgaccggccagaccagcgatggtccgaacaaagttagcctggcgcaggcggcgggtaccagcgtggcgggtgcgaccgttctggcggcgaccgcggaggcgagcggtccggacggcaactacaaagcgaccagcctgagcccgagcagcacctggagcgtgagcggtaacaccggcagcttcaactggagctatccgattccggtgccgccggttccgggtgatctggcgccgcaggttgcgctgggctataccagcgcggcgattgacggtcgtaccgcgagcaccaacaaccaaagcagctggatcggtgacggctgggattacaacccgggttttattgagcgtgcgtataccggttgcgcgggtgacaaaggtagcggtagcaacgcgccggaaaccggtggcgacctgtgctggaaaagcgataacgcgaccgtgagcctgaacggtagcagcagcgcgctggttcgtgacgatgcgagcggtacctggaagctgagcaatgacgatggcagccgtgtggagaaactgaacggtaacgcgaccgataccgcgaacggcgacaccgataacgaatactggaaggttaccaccaccgacggcacccagtatttctttggcaagaaccgtctgccgggttggagcgcgggtaaaccggagaccggtgcggcgctgaccgtgccggttttcggcaaccagccgggtgaaccgggttatgcgccggcgtttaaagacagcagccgtgatcgtgcgtggcgttggcagctggactatgtggttgatccgcacggtaacgcgatcgcgtacttctatgatcaagagaagaacgcgtacgcgaaaaacattggtgcggcgaccggtaccagcaaagcggatgcgctgtatacccgtgcggcgaccctgaaccgtatcgaatacggccaccgtgcgggtcaggtttataacgcgagcccggcgggtaaagtgaccttcagcaccagcgaccgttgcgttgagaccgattgcagctttaccgaagcgaacgcggcgtactggtatgacaccccggtggatcagagctgcgacaagggccaagattgccgtaacggtgcgccgaccttctggagcaaacgtcgtctgaccggtatcagcacccaggcgctgcaaagcaacggcagctacaaggacgttgatgcgtggagcctggaccaggattttccggcgaccggtagcagcggtggccgtgcgctgtggctgaagaccattacccgtaccgcgaaagcgggtagcgcgcagctgaccctgcaaccggtgacctttggtggcgacctgcgtccgaaccgtgttgatagcgcggagggtcgtagcccgatgaaccgttaccgtgtgaaccgtatcaccagcgaaaccggcagcaacaccgatgttaagtataccgacattgattgcgtggcgggtgcgctgccggcgccggacagcaacacccgtcgttgctatccgtcctggtggaccccggagggtggcgcggaaccggttttcgactggtttcacaagtatctggtggagaaagttaccgaacatgatctggtggcgggtagcggtagcccggacaaagttaccgcgtatgagtatctggatggtgcggcgtggcgtcgtgataacagcgagttcaccccggacaaggaacgtacctggaacgattttcgtggttaccagcgtgtgcgtacccgtatcggtgacagcggcaaaagcctgaccgaaaccgtttatttccgtggtatggatggtgataccctggcgaacggtcagccgcgtccggttagcccgctgcaaggtgtgaaggacagcaacgagctgaccggctttgcgcgtgaaagcattgtgtacgacaaggacgataaagatggtggcaaaccggtgaccagcaccgttaacaacccgtggctgcgtagcaccgcgagccgtgcggttaaggcgctgccgagcaaggataacaaaaccgcgaccccgccggcggagaaagatcgtccggaagtggcggtgctgccgccggtgaccgcgacgatggtgcgtaccgagagcgtgaccaccaacgcgttccaaccggatggtagcaccgcgcgtaccctgcgtgaaagccgtacctttgacagctacggtcagaccaccgcggttagcgacgagggcgataccaacgtgaccggtgatgaacaatgcacccgtaccacctacgtgaccccggacaccaccaactggctgatcagctatccgcgtagcgttcaaaccaccagcaccctgtgcagcaccaacgcgaccccggcgaccgtgaccagcgaggcgcgtaccgcgtacgacagcaaaccgctgggtagcgcgccggagccgggtaaaggctatgcgaccaccaccgaagcgctggaccgttacgatggcaccaccccgcactatctgaccgttagcaccaccgcgtacgatcagtatggtcgtgcgaccagcgtgaaggacgttaacagcgcggaaaccaccaccagctacaccccggcgagcggtagccaggcgaccgtggttcaaagcaccaacccgaagaaattcaccaccaccaccaccaacgatggtctgcgtgcgctgccggtgaaagtggttgacgcgaacaaccgtaccacccacgtggactatgatgcgctgggtcgtaccaccgcggtttggaacccgggccgtgacaagaacgcgagcccgaacgttacctacgcgtataccgtggaaccgggtaaacaaccggcggtgaccacccgtaccctgctggaaaacggcgattaccgtaccagcatcgcgctgtatgacggtctgctgcgtccgcgtcaggttcaagacgaggcgtatggtggcagcgaagcgcacaacggtggccgtaacatcaccgacagcttttatgatagccacggtcgtatttaccgtaccaacgcggcgtatcacagcaccggtaccccggaggcggcgctgtggattggtctggacaacaaagttccgagccagaccgagaccgagttcgacggtctggatcgtccgaccgcgagcatttttaagagccagaacaaagaacaatggcgtaccaccacccgttacggcgtgaactggggtgcgaccaccccgccgggtggcggtaccccgaccctgaccatcaccgatgcgcacggtcgtaccagcgaggttcgtcagtacaaaagcggtagcccggactttggtgcggatgcgagcgcgtatgaaaccctgaagtacacctataacccggcgggtaaactgacccgttttaccgatgcggcgggtaacgcgtggacctgggagtacgacctgctgggtcgtcaaaccaaagcggtggacccggatcgtggtaccaccaccagcagctataacgcggatggtaccctggcgaccgtgaccgatgcgcgtggtcgtaccctggcgtacacctatgatgttctgggccgtaagaccggcatgttcgacggcagcaccaccggtccgaaactggcggagtgggcgtttgataccctgccgggtagcaacggtctggcgaccggcagcacccgttgggaaaacggcaaggcgtacaccagcggtatcaccggttttgatggtgcggcgcgtccgctgggtagcaccgttaccatcccggacagcgaaggtgcgctggcgggtacctacaccaccgcgcagacctataccccgaacaccggtctgggtgacaccaccacctacccggcgggcggtggcctgcgtcaagagagcatccaccgtgattataccctgctgggtctgccgaccttcgttaccgacggtggcaaccaggtgtacagccaaggcaacacctacaacgaatatggtcagatcacccaaagcagcattggccgttttggtagcggcgcgtaccagacctacgtgtatgaggaacacaccaaacgtctggcgcaggcgcgtaccgatggttatagcaagccgcaaaccctgaacaacaaaacctacacctataaccagatcggcaacattacccaagtgcgtgacgcgcgtggtaacccggcggttaccgacacccagtgctacacctatgatttcgcgcaacgtctgagcaacgcgtggagcgcgaccgacaactgcgttgcgcagccgaccccgaccaccgacccgtacgtgggtggcgttgatccgtattggaccaactacacctatgatgcggcgggtaaccgtacccaagcgaccaaccgtaccagcggtgcggcgccgggtccgctgatggacaccaccaaggtgaccagcgttgcgattgcgggtgatggtcagaccagcgcggttgcgattgcggacggccaagtgtacctgagccagcaacgtgcggacggtacctgggcgaactttgagaacctgcaccgtacccaagcgggtccgctgccggcgccggtggattatgtggcggcggcgtgggcggacaacaccctgcaaatcatggcggtggcgggtggccgtatttggcacaccctgcgtggcgcggatggtaaatggggtggctggggcgacgttaccagcgtggttggtagcattgcgaacccgagccagctgagcctgagcgcgaccgcgagcggtctggaagttctggcgctgagcgatggcgtgctgaagcacaccctgcgtaaaccggacggcaactggagcacctggggtagcgtgtacagcgagaccggtagcctgaccggtgcgacccgtgttaccagcgcggcgaccagcaccggtctggaagtgatcgttattgcgggcgataagctgtggcacaccgtgcgttacccgaacgcgagctggagcaaatggggcgacgtgtatagcgttaacggtgcgctgaccagcccgaccaacctggcggcgaccgcgaccgcggcgggtctggagaccgcggtgatcgcgggtggcaacatctggcataccctgcgtaagccggatggcaactggaccagctggggtaacgttagcctggtggttggtccgctgagccagccgaccagcgcggcggtggttagcagcctgggtgacctgaagctgatcaccgtggcgggtggcaccctgaactacaccaaacgtagcagcagcaccggtaactgggcgccgtggagcagcctgacccagaccccggaaaacccgcaaaccagccagaaccagcgtaccagcacctatccggcgccgggtggcacccgtccgcacgcgctgagccgtgttgatattaccggtaccggcgcgcgtaccgacaccttcacctatgacgatgcgggcaacaccgtgcgtcgtgttaccgcggatggtgatcaggcgctggagtgggataccgaaggtcacctgaccaagagcaccaccgcgggcaaaagcaccacctttctgtacgacgcgaacggcaaccgtctgctgcgtcgtgagccggatgcggtgaccctgtatctggatggtcaagaactgaagctggacaaaaccgcgaacaaggttatcggtacccgttacattaccgttgcgggcgcgaccatcgtgaaagcgagcgatggcaccctgaactatctgatcaacgaccaccagggtaccgcgcaactgaccattagcgcggataacctgtacacccgtggcgacaccaccccgtttggtaccccgcgtggtcgtaaaccggcgagctggccgaccgagcgtggttttgtgggtggcaccaacgatgcgaccaccggtctgacccacctgggtgcgcgtgactatgatgcggcgaacggccgtttcatcagcgtggacccggttctggacctgaccgatccgcagcaaattaacggttacgcgtatagcaacaacaacccggttaacctgaccgatccgagcggtcagcgtccggaaggtatctgcggtggcttcggcacctgctacgacagcaagggtaacattaacaccgagacctttaaacgtgaagacgatggcacctacaccgagaactattggaaccactggagcggtagcaaggaaaacccgaacgtggttagcccgcacatgcacatcatttaccgtggtggcagcctgaaacagaacgtgcacggcatgtttgacagcatccaatatattccgggtgttagcgcgattggtgcggtgggtagcgcggttatggacgcggcggatggtcactatatgagcgcggcgcaaaacctggcgggtgcgattccgggtgaacgtctgtttgcgatggcgggtaaagcgggcaaggcggcgatggcggcggaccgtgcggaagatgtgggtaacgcgaccgcggatgcgctgagcattctgagctgcgatggtgcgcaagcgggtgcgatgcacagctttccgccgggtacccgtgttctgctggcggatggtaccacccagaccattgagagcctgcaactgggcgaccaggtgcaagcgaccgatccgaccaccggcgagaccgaaagcaagagcgttatccgtaccattcgtaccccggacgatgaacacttcaccgatctgcagctgcaggttaacgcgagcgatggtgaaccgggtgcggttgaaaccctgaccagcacccagcaccacccgttttgggatgagaccacccaccaatggaccaacgcggcggaactgaccccgggtgacaccgtgcgtaccgttgatggtcgtaccccgaccgtgctggcggttcgtaactacgacaccgcgccgcaggtggcgtatgacctgaccatcgcggatctgcacacctactatgttctggcgggtgcgaccccggtgctggttcacaactgcggcgagccgcgtttcagcgtgggtagcgacggtgtggttgaagatctggcgaacccgctgccggttcgtggtggctacgtgccggttccgaagctggatggtggcaccgtgccgggtgttggcaacaaaatctggggtaacagcgacccggagcacctgattggtacccgtagcccggaagcgctgcgtggtattgcgagcaaggcggacgcgggcaaactgcaggatttttatgcgggtgcggcgaacgcgggtaaaggtggcgcgagcggtcgtggcagccagaacagccgtaacccggttgataccgcgcgtaaccgtgtgaccctgctgcaagagatcattgacgcgtggagccaccaccaccaccaccactaataagaattc

SEQ ID NO: 529 - DNA, 1118 bp, Artificial Sequence
  Optimized for E.coli
ccatggacccggcggaagtggaccgtgataccctgaacgacccggattttctgaaggataaagaagcgctgctgtacttcagcaccgcggcggaccaggatacctttggtggcggtaaaagctacgcgatcttcgcggacgagaaaggccgtctgagcagctatcacatgaagggcctggaactgggtagcgcgaaagtgcacgacggcagcgttctgctggaggataagaaaggtatctacaccgtgcagggcggtctgcacacctacaagcgtgcgtatcaacacaccggcgatagcgcgggttacattgagcgtaccaagggcttttacaccctgtataacagcggttatgacaaaagcggcggtagctaccgtagcgaactgtatcgtcagattgatggcaagtggaaacaaaacgttatcccgcactacattcgtgcgagcggtttctttaaggaccacctgttcgcgctgaccccgaccgacgatgagaaaggctaccacgtgcaggacatccaagcggataaggaaaaactgcacaccaccagcattgcgacctggacctataaagagggtaccagcgttgaaagccaactggcggcggatgatagcgcggtgtgctttgttacccgtggcgaaaaagcggaccacatctaccaaatggtgaaggttatgaaaaacagcggtgcgatcaagacctacgatattgcggcgtataaaaacgacgagcaaaccatttatgatagcatgccgttcagctttaagaaaagcttctttatggaacgtcgtagcttctactttgtggacggcttcggtaccgtttatcgtatcaacccgaagaccggtaaaagcaagaaagcgtttgcgctgccggcgagccgtatgaaggcggatttcaaagagctgacccaccagaacggcaagctgtacctgtttacctacagctataagaaaccggcgaagattgaaagcttcgacctgaaaaccggtaagaaactgaacgatcgtaccatcccgaacctgaaaaacattgttaccccgaagagccacctgaaactgtatgacgtgcaagttatgggcggtttccaccaccaccaccaccactaataagaattc

SEQ ID NO: 530 - DNA, 3161 bp, Artificial Sequence
  Optimized for E.coli
ccatggcgaacaccctggaaaccgtgcaagttaccgcgaccctgccggttggtggcggtggcgcgggtggcttcggttttggtggcggtagcggcgtgcacctgagcgaaagccaaatggacaacggcggtggcggtggcgcgatcccgaccgagaccgcgaaggaacaaccgaccgacgataaggagaaagattgcaacggccgtaagggtaacccggtggttctgtacagcggtaacaaagttgagccggaactggacttcgcgagccagggcgagatgggtctgtttctgcaacgtaactataaccactactggagcgcgaccggcctgtttggtaaccactggctgagcaacttcgactacagcctggcgtttaccgatgcgaaccaactggcgtgggtgcaacgtccggatggtcgtcgtatcaagtatctgaaagatccggcgagcggccgttggtacgaagacaaggcgcagccgattgcgtatctggcggcgaacggtgatggcaccttcaccctgcgtaacgagaacaacggtaccgaaatctataacgcggagggctacattacccgtctgagcaacgagcagggtgttagctggaccttcagctataccgatcgttacctgcaaaaagtgacccacagcagcggccgtagcatcagctttggctggaccaacggtcaagtgagccaagttaccgacccggcgggtaacatttaccgttatacctacaccccgaacgtttttggtaacggccgtggtcgtctggcgagcaccaccctgccgggtgcgccggcgaccaccatcagctatcactacgaagatggccgtttcccgggtgcgctgaccggtaaaagcttcgatggtgtgcgttatagcacctttgcgtacgacgcggaacgtcgtgcgatcagcaccgaacacaacggtggcattgagcgtttccgttttagctatgcggttcgtagcaccgaaccggtgctgccgccgccggcgccggcgcgtccgggtggcgttcgtgcggatgaggaacgtggttggtgcgaacagcgtccgggtggcagccgtatctgctaccaaccgcgtagcctgccggttgatagcctgccgatggagagcgcgctgggtatgaccgcggcggcggcgccgagcctgacccgtccggtggacatcgatgtgaccgttattaacccgctgggtcgtagcaccacctacaccttcaaggatggtaaaatcgttagcaccaaaggtgacccgagcccgaactgcccggcgagctataaagaacagagctacgacgcgaacggttatccggatctggtgcacgacttccaggataacctgaccaactttgactacagcgcgcaaggttatctgctgaaacgtgtggaggcggttggtagcaccgcggaacgtaccaccctgcaagagtgggataccgcgcgtaaccgtctgctgaaaaccaccgtggttggtgacctggaagttgcgtatacctacgacgatcgtggcaacgtggcgagcgttaccgagcgtaacctgaccgcgcgtggtgttccgagccagacccgtgtgacccgtaccacctatagctaccacgcgaacggtctgaaggcgagcatcaaaattgatggtccgctgccgcaggatgatgtgaccagcaccttcaacaaccaaggtgacctgaccagcaccaccaacgcgctgggccacaccatcagctacagcaactttaacggcctgggtctgccgggtcgtattgttaacgcgaacggtggcgtgcgtgaactgacctatgacggccgtggtcgtgtggttagcgatcgtaccagcagcggtaccggttgggcgaccaccgcgattggttacaccagcgcgggtgacattgcgagcctgacccaaccggatggtgtgaccgttcgttatggttacgatgcgggtcgtcgtctgacccatgaagttcgtagcctgggtgatggtacctgggcgtggacccgtcacagctacaacaacgcgagcaaccgtacccgtaccgaagttagccagaccgactatccgatcgataccgcggtgaagggtatgatcgacgagattacccacgatggccagtggaactggtttgcgcgtggctgggcgtgcagcaccggtagcgcgggtagcattcaagttgacggttacgcggaaggcaacgtgtatctgggtagcacccaggcgaacctggcgagcgagccgggcgttgcggcggcgtgccaagcgagcggcaacggttatcgttaccagctgccgatcagcctggcgcaacgtcagcaactgggtggccgtaagttcagcatttacggtgtgagcccgaaaggcgcgcagcacaaccaagcgctgggcaacagcggtaactttgcgatcccgaccgcgaccatcattggtgacgtggcgggcgttaccaacgatgcgaactggaacttcagcgttcagggttgggcgtgcagcgtgggcgttaacgcggcgaccaccgtgcacatttatgcgggtggcccggcgggtgcgggtacctatctgggtagcgtgaccggcaccctggttccgaacgacgatgtgaaggcggcgtgccagagccagggtgcgtactggttcggctttaccctggatagcaacatgcgtaacgcgcacggtggcaaaccgatctatgttcacggtattagcccgagcggtcaggcgcacctgctgctgaaccgtagcggtacctttaccgtgccggcgatcgttcgtaacgcggaagtggttggcgcgagcgcgtatccgtaccaaatcttcaacggtggcagcagcaccctgattttcgagtttcgtaacaccagcaacgtggtttggaacccgggtgacacctacctggcgtttggcctgaaccagccgaacgaaaacattgcgctgagcgcgccggttccgccgggtggcgtggcgcgtttcagccgtagcgtgggtccgaacaacccgggcagcggtaaccgtacctttagctatgttgcgcgtatggcgagcggtggcgtggcgtggggtgcggaagcgaaggtgttcctgagcgttgagaacaacaaaggcagctgcggtcgtgtggtttgcgagcgtccgcgtcaccaccaccaccaccactaataagaattc

SEQ ID NO: 531 - DNA, 3161 bp, Artificial Sequence; identical to SEQ ID NO: 530
  Optimized for E.coli

SEQ ID NO: 532 - DNA, 986 bp, Artificial Sequence
  Optimized for E.coli
ccatgggtagcaccgcggagaccgatctggttgaaaccccggcggcggatccgcgtgttgaggtgctgccggcgcgtgatgttccgctgggtggcccgcgtgcgatgaccgtgcgtcgtaccctgccgcagcgtagccgtaccatgattggcgcgtggtgcttcgtggaccactatggtccggatgatgttgcgggtaccggtggcatggatgttgcgccgcacccgcacaccggtctgcaaaccgtgagctggctgtttaccggcgagatcgaacaccgtgatagcctgggtgtgcacgcgtatgttcgtccgggcgaggttaacctgatgaccagcggtcgtggcattgcgcatagcgaagtgagcaccccggcgaccaccgtgctgcacggtgttcagctgtggattgcgctgccggaggaacaccgtcacaccggtcgtgactttcgtcaccatgcgccggcgccggttaccctggatggtggcgaggcgcgtgtgttcctgggtaccctggcgggtgacaccagcccggttccgacctttaccccgctgctgggtgcggaactgaccctgcgtccgcatgcggtggttaccctggacgtggatccggcgtttgagcacggtctgctggttgacaacggcgaagttcgtctgctggataccccgctgcgtccggcggaactgggttatgttgcgccgggtcgtcgtaccctgaccctgaccaacaccggtgcgaccgatgcgcgtctggttctgctgggtggcaccccgttcgaggaacgtatcgtgatgtggtggaactttattggtcgtagccacgaggatattgcgcgtgcgcgtgaggaatggcaagcggcgagcgaccgttttggtaccgtgcaaggttacccgggtgatcgtctgccggcgccggaactgccgggtgttccgctgaagccgcgtggtaacgtgcgtcaccaccaccaccaccactaataagaattc

SEQ ID NO: 533 - DNA, 2444 bp, Artificial Sequence
  Optimized for E.coli
ccatggcgccggcgccggcggcggcgggtgcgccgctggttgacggtggcagctatcagctgggtagcgcgctggatggtagctgcctgggtccgcagtatgcgcaaccggcgccgggtaccccggtgctgggtgcggcgtgcggccgtctgctgagccagcgttggcaactgcgtcgtaccggtggcgactatctgctggttaacgcggcgagcggtcgttgcctgaccctgggtggcccggacctgcgtccggcgaccgcggattgcggtagcgcgccggaggcggaacgtttcaccgtgagccgtgcgccgcagggtacctacaccctgaccgttcgtggtaccggtgcgtgcctgaccgcggacccggcgccggtgaaccatcactgcgatcatcgtccggcgcaccgttggaccctgacccgtaccgagccgctggttctggcggatccgggtttcgaacaaagcagcggtagcggcgcgccgaccaccggtgctcctaccaccggtgcgccgaccaccggtgcgccggcggcggacagcagcagcgcggcggatagcagcagcgcgaccggtggcccgagcaccgcggcgggctggacctttaccgcgcacaccggtaccgcgaccaacaacccgcacggtggcagccgtctggcgtatctggatgcgggtccgggttacaccgtgagccagcaagtgaccgcggttaccgcgggcacctacgatctgagcgcgtggattgcgaccggtggcgcgggtggcagcctgagcgtgagcgttaacggtaccgtggttcgtagcctgccgctgccggagcagagcacctacgcgaagtataccctgccgcgtgtgcgtgttgcggcgggtgaccgtctgaccctgaccattggtagcagcccgaccggttgggtgaacgttgatgatgcggcggtggcgccgagcgcgccgaacgacccggttattagcagcagcgatccggaagtggttgcgctgttcgactgggcgaagaccaaagcgaacagctgggtgcagcaaccgggtgcgaccggcgttctggaccaggatgaaaaccatccgggtggcaccggtaccaccacctacgatgcgagctattgggcgggttacccgttccgtagcgcgttttatagccgtgactttgcgcaccaactggttggcgcgcacctgctgggtctggatgcggaaaacaaaaccatgctgcgtggcttcgcggcgagcgcgaccgatgtgaaccgtctgtacccggtttgggcgctgaactttgatgcgcgtagctatgcggcgatcgactaccgtggtccggatcgtttcgtgcgtgagctgccggcgccgtttgaactggttcaacaggcgggtgaagcgttccgttggaccggtgaccgtgattatgcggaagacccgggtctgggccgttacgtgcgtaacaccctgggtccgttcattgcggcgcgtccgggtccggtggataacggtggcgttccgatcccgcaggcgaccagccgtagcatttttgcgggtaccgcgagctatgcggagaacgcgacccgtacctatgcggaagcgggtgatgcggttggtgcgcagtaccaagcgtatctggcggcggcgaccctggcggaagcgcgtggcgacgcggcgagcgcggcgggctatcgtaaggcggcggatcaactgcacacctacgtgaacaccacctggagcgttgatggtagccgtccgggcgaggtggttcacggctatgataccaccggcaagccgattaccggttggggctacgaagcgagcgtgctgatgccggttaagcgtctgctggatccgggtccgcgtcgtgatggtttcctggcggcggtggatgcggcggatagcggtccggagcgtagcgcgaacctggaagcgtacacctatctgccggacgcgttctttgcgaaccacgatggcaccaccgcgtggaaatggatgcgtcacatctatgaaagcaccggtgaaccgcatgtgagcggtgcgatgctgaacggtgactacccggaagtgccgtttaccctgctggcgcagaccgtgcaaggtctgctgggcgttaccccggatgcggcgggtcatgcgctgaccaccgcgccgcagctgccgagcagcatgggctggctgcaagtggcgggtattccggttggtgcgggtaccgtgaccgttcgtcatgatggtgcgcagcgtagcaccgttaccaacaccggtaccgagcgtctgacctgggaagcgcgttttccgggccaacatgcgcgtgttaccgttgatggtgcgccgcgtgaagcgcgtaccaccaccgtggatggcgttacctacaccagcaccaccgttaccctggcgccgggtcgtagcgcgaccgcgaccgttaccgatcaccaccaccaccaccactaataagaattc

SEQ ID NO: 534 - DNA, 4202 bp, Artificial Sequence
  Optimized for E.coli
ccatggaaagcaccagcgatcagaagcaagcgcaggagaagaaaaccgacgatgttaccgtgctgcaagaaaagagcgacctgaaaagcaccggtaccaacccgagcgaggtggttgtggcgaacggtaagaaaggcagcgaactgttcgactttgaggcgttcatcaaaccgagcgatattgtggacggcaccgcgccgtttgatagcaacgacgaggcgggtaacgatagcagcccgaacaacggcatcgttcgtaccttcgacaccgtgacctacccgctgaaagttaccattaacccgaagaaaaacgaaaccctgaagaacatcaagatgaaaattaccggtaccctggagaacggcatcaccaacaagcgtgtgaacgcgaaattcgcggttggtggcaaagaggacctggaaaaaggtatcgttagctttgacatggaatacaccctgaaggagaccggcaacagcctgatgattccggttaccgtggaagttcagggtgcggagcacggcctgaagctgaaaccgaacatcaaaattcaggttatcagcgtggatggcaaggacattgcgaacgaaaacgtgagccagagcttcgacggtatcagcccggttaccaccagcggcaaggtgaacgttaaagcgcgttttaccgcgagctatggtggcatgccgcgtctggattataaagtgtacgacccgaacgcgaaagaggacgatcgtaccatcatttatccggtggcgctggacctgttcgttaacaacctgccgaaccgtaccgacctgcgtggtgcgacctttccggcgggcaagatcaactaccacttcaactttagcggcaaggttgactgggattataaaagcctgggtgcggaaaccctgaacttcgagggccgtgacaagccgatcaaaatttttaactaccaagcgatcgataagattgttgacaaagtgccgcaggaaggtaccgaaagcttcgagatcggtatgaagggctataaagatccgcgtaccgaaaccgcgaacagcccgaagagctacatcccgaaagacatttggaacgcgagcgacatcgataaatataccattgatagcgtgtgggacagcggtaccgttcgtctgaacaagccggaaatcaccaaagatcgtgtgggttacaccggcagcatcgaggactatgttattggcagcaccttcccgaccatgatgagccgtccgggttacagcgtgatcccgacctttggcaagaacgaaaaagcgttcagcagcacccgttttctgattcacagcaccaacgagtactatccggttctgggcaagaacaacaaagacaacctgccgaacaacgtgttctactatctggaatttgttatcgatagctacgaggacggcaagggcaacaccattccgtacaacaccgtgggtcgttataccctgaccgaacgtaacaacccgaagggcgcgtacagcatccaaaccaccttccacaccaccgatcacaaagagctgggtaccccgaacgttggctatagcgctgtgagcaaaggtgacccgaccgtgatcgttggccagaacgttaaggttgtgagccacctgaacgttcgtgcggtgaccgagggtggcaccaccatgatttacaaatggaacaccgatagcttttatctgagcaaaaacagcgcggaaaccgcgcgtaagaacatgctgaacgagggttacccgaacaccagcgcgggtcgtgtgaccaacagcgataagcagaaaatctatttcggtattagcaagaaaggcgacaacagctttgaaaccctgacccaaaacaaggacgaggattatgactggtacagcacctatgacgaagcgaagaaacagggtgaggttgcggcgatcaaaaacgatattaacgcgagcatgggtgacggcgaagttgtggcgtggaacatcccgctggaagtgaaaaccaagaaaattggtagcgttaacgaaaagggcaccccgaacatcaccgttaccgatagcattgtgtacccgagcgcggaccgtaaagttggttatcgtgtgcgtggtgagggcaagtacaacaacttcaccgaatatgatgagaagggtaacatcaccaaactgcaaagcccggttggcagcaccgtgaactttgaaaccctgggtattatgaacggcgagaccagcagcgacgtgaagaccaacaaaaacacctactatagcagcgataacgtgagcgttaccgtggacaacctggttaaactgccggatgcgatggactacaacagcctggacgaaaaggttgagatgcgtgtgaagatcccgaaaggtctggattatgttgtgggtagcgcgaaatacggcgaccagtatatcgaaccgaagattgagcagcaaaacgatggtagcaaccacctgatttggcacgacaccctgacccgtggcaacaagaccctgaagaaaatcaacttcgaaacccgtattaacccggtgctgctgccgcaaggtaaccaagtgggcctggaaatcaccaacgttctgagcagcgcgatggatacccgtgcggagaagtttcgtaccagcagcaaaaacatcagcgttgtgaagattggtatggttggcgtgagcgaaaccattgagaaagtgaccggtaagaaaaacagcgattacgttgtgggcgttcaaccgtataccaccatcaaagacgagagccacattaaggcgctgacctacgtgccgcgtaacaaggaccacaacggtagcgcgttcaacggcgttacctttctgcgtcagatcgcgctggaaaacgcgaacaacaaaaacgtggagatttggctgaacaacagcttcgttgaaagcaacaacccgaacaagatcgatctgaaaagcaacggttggtaccgttataccggcgagcaagacctgagcaaggttgtgagcatcctgctgtacattaacgatagcctgagcagcagcgacattgttaaaatgaacctggtgtacggtacccacaagaacgagttcggcgatttttatgtgagcaagaccgttgtgaacaccagcgttgactacaaactgagcccggttagcaaccaggtgaagtataccatcgtggcggatgcgaacctgggtctgcgtaaaatccgtattgataccgcgccggcggacattggtctgccggttattgtgcgtctggataaagacatcatttacgaagacagcaacaagagcaacgttgcggtgaacctgtatgataagagcgacaacaaactggttgatagcaaagtgtacaccatccaggagctgccggaggaaattaagttcaaagttgacccgaaatttctgaagaaaaacaataagcgtaactacgaagttcgtttcgagaaggtgaacaaagagagcatctttattgtggacggcaagggcaaagttgataccgacggttacaccagcagcgaggaaaccgtgaaggcgaacaccaaagcgagcaccgaactgaagtataaaggtgttatcatgaccgagcgtgaagtgggcaaagagatggaagttttctacgagaccctgaccattccgctgaagcaactgccgaagcagaaaaccggttatggctttgaactgaaaccgctggttagctacaacaacgagctggcggttagctatgatgtgaaaaccaacgcgctggttgataagcgtctgatcgacagccacctgaactacgaaaagaaaggtgaccaattcgttgtgccgctggaggaagcggagaagaccggcagcaccgataagaaaaacaccgactacctgttcgaactgccgcacatcaacgtggagcagaaaaccggtaacctgtttaccgatcagcaagttaaggatcacgacccgcgtatcaagaacgcgattaaagatggcaagcgtaaactgtacgtgccgatctgggcggacctgggcgaatataacgttctgattgtgagcggtatcccgattggcgcgaacaaggttaacttcgaggtgacccaaccgctgaacctgtacgcgtatatgtacggtaccatcggcagcaaaaccctggaagacgatgagctgctgctggagccggttgacccgaaaaacccgtttagcaacggcaagccgccgggttggagcgatgttgatgtggcgtggctgaaacagcaccaccaccaccaccactaataagaattc

SEQ ID NO: 535 - DNA, 698 bp, Artificial Sequence
  Optimized for E.coli
ccatgggtaaggagaaagaaaccgcgcgttacgcgaaggagattgcggatctgcagcaaggcaccaccccgcaggacgtgctgcaaagcgcgaaggaactggcgaagcagaaacacgttagcaccgaggcgatcctgaaacagttccaccaagaaattaccgcggataaggtgcagggtaacgtgattgttagcaaagagggcctgagcgcgatgggtggcagcagcggtaccaagaaactgccgaagagcaccaaaggcaacatctactataccaacagctacaccgcgtactataaccacggtcacgtgggcatgtatagcagcgcggataagatcgtggaaagcgttccgggtgacggcgttcgtcagattgcgtacaacggtcgtgaggtggaagataacagcatcgttcaaaccgtgaaggttaccgacgcgcagaagcaggcggcggcggattgggctgtgagccgtgttggcgacgagtatagcttcaactttgtgaacaaccgtaacaccggtcacgaaggcgcgaagaactgcagcaaactgctgtggagcgcgtttctgctgaaagcgggtatcgacattgatagcaacggtggcctgggcgtttacccgcgtgacatcaccagcagcagctataccaccaccatcctgaccattcaccaccaccaccaccaccactaataagaattc

SEQ ID NO: 536 - DNA, 1997 bp, Artificial Sequence
  Optimized for E.coli
ccatggcggtgacctgcaccagcccggtgtggcgtgttcagtacttcggtaacagcacctttagcggtaccccgaagctgaccgcgtgcgacagcgcgatcagcgagaactacggttatggcgacccgaccggtgtgaccctgccgaaagataacttcagcgttcgttggagcctgacccgtgattttggtagcggtggcccgtttcgtctgagcgcggcgacccaagacggtatgcgtgtgtacgttgatggcgtgcgtaagatcgacctgtggaaagatgttagcaccaccgcgcgtaagggtgtggacctgaccgttccggcgggcaaacacaccattcgtgtggatcacgttgcgtggaccggtctggtttacgcgggctttacctatgcgccgcgtaccgcggcggcggttgacaccgttaaaccgctggcgccgaccggtctgaccgcggcgtacaaccgtgacaccaccaagaccaccctgcgttgggcggcgaacaaagaaatggatctggcgggctaccgtgtgtatcgtcgtctgagcaccacccaatgggcgaaggcgagcggtagcagcctgctgaacagcccgagctttgttgatgcgaccccggcgaccggtcaaagctttctgtatgaagtgcgtgcggttgataaagcgggtcgtgaaagcgcgggtagcctggatgcgattgcggcgaccgtggatcgtaccggtccggcggcgccgaccggcctgaccgttgcgagcgacgcgtggtgggcgaccctggcgtggcaggcgggtgcggatgcggcgcgttatgaggtgtatgcggcgagcgcggcggcgggtccgttcgaactgctgggcaccaccaccaccaccagctatcgtaccgatgcgagcgtgaacaccgcgcgttactatcgtgttcgtgcgctggatgcgctgggtaacccgagcgcgtatgcggcggtgaccggtgatggtgttgatcgtaccccgccgaagagcccgaccagcctgggtagcgtggttcgtgtgggcgacaccgaggtttactggaaacaaccggatggtttctatgaagactttgataacggtggcacctaccgtgtgtatcgtagcccgggtaaaaccctggatctggcggcgctgacccgtgttacctgcgcggaggaaagcgatgagaccagcaccggtggcatttgccacgacctggatgtgccggcgggtacctacgttagctatgcggtggttgcggtggatccggcgggtaacgagagcgcgccgagcgcgccgctggttgtgcgtaccggtgatcgtgtggcgccgggtccggtggcgggcgttaaggcgaccccgcgtaccgatggtgttctgatgagctgggcggcgagcaccgaggatgatgtggaacgttacgttgcgtggaccggtgcgcgtcaggcggatggtaccgttaaatggctgagcagcaccagctgcgcggagggtaccagcgatccgctggcggtgctgtgcggtgacctgccggatggcgaaacctacgtttatgcggtggttgcgaaggaccgttgggataacgcgctgccgccgaacgacagcaaagtgaccgtggttgaggcgaccgaaccggatgttcgtccgagcgtgaccgttacccgtgactgggatctgggtagcatgggctacgacaccatcattggtggcccggacctggatggtccgtatattaactggcgttgcgacaagaccgcggagtgcgataccgtgaccggctaccgtgttagccgttggaacgcggcgaccaaagcgtatgaaccgctgcatgcgggtctgctggcggcggaaacccgtgcgtacaccgacaccaccgcggcgcgtggtaccacccacttctatatgctggaagcggtgcgtgcggatggtagcgtggttggtacccacgtgtggagctgcgtttttcaagatcgtgttcaccaccaccaccaccactaataagaattc

SEQ ID NO: 537 - DNA, 1997 bp, Artificial Sequence
  Optimized for E.coli
ccatggctgttacctgtgcaagtccggtgtggcgtgcgcagtactttggtaacaccacattttctggcacaccgaaactgaccgcttgcgacgcagccgttaacgaaaactacggttacggcgacccgaccggcgttacactgccgaaagacaacttttcagtgcgttggagcctgacacgcgactttggttcaggtggcccgtttcgtctgtctgctgctacccaggacggtatgcgtgtttacgtggacggcgtgcgcaaaatttcactgtggcagaacgttagcaccacagcacgtaaaacagtggacctgaccattccggccggtaaacacacaattcgcgttgactacgtggcatggacaggcctggctcacgcagcctttacatacgccccgcgtaccgaagcggctgttgacacagtgaaaccactggcaccaacaggcctgacagcagcatacaaccgtgacaccgccaaaaccacactgcgctgggcggctaacaaagaaatggacctggcgggttaccgtgtttaccgtcgcctgggtaccacacagtgggctcgcgcaggtggtagcagtctgctgacctctccgtcatttgtggacgcgaccccggctaccggtcagacctttctgtacgaagttcgtgccgtggacaaagcgggtcgcgaaagcgttggcagtctggacgcaacagccgttaccgttgaccgtacaggtccagcagcaccaaccggtctgaccgttacaggtgacgcatggtgggcaacactggcttggcagggtgctgctgacgcagcaacctacgaagtttacgctgcttcagcagccggtggcccatttgaactgctgggcaccacagcaaccacaagctaccgtacagacgctccggttaacaccgcacgcttttaccgtgtgcgcgctctggacgcactgggtaacccgagtccgtacgctgctgttacaggtgacggtgtggaccgtacaccgccgaaatctccgacctcactgggtagcgttgtgcgcgttggctacaccgacgtgtactggaaacagccggacggtttttacgaagactttgacaacggtggcacataccgtgtttaccgctctccgggtaaaacactggacccggcagcactgacaccggtgacctgtgccgaaggtagtgacgaaacctctacaggtggcctgtgccacgacctggacatgcctgctggtacatacgttacatacgcagttgctgctgtggacccagcaggcaacgaaagtgccctgtctgcgccgctggttgtgcgtacaggtgaccgcgtggctccaggtccagttaccggcgtgacagctacaccgcgtgcagacggtattctgatgcgctggagcgcaagtaccgaagacgacgttgaacgttacgcggtttggacaggtgtgcgtcaggctgacggtaccgtgaaatggctgaccacagcgagttgtcgtgaaggcacatctgacccgctggctgttctgtgcggtgacctgccggacggcgaaacctacgtgtacgctgttgtggcacgcgacctgtggggtaacgcactgccgccgtcagacccgaaagttacagttgtggaagcgaccgaactggacgtgcgtccgtcagttacggttgctcgtgactgggacctgggcagcctgggtcacggcaccgttattggtggcccggacgaagacggtccgtctatttcatggcgttgtgaccgcacagccgaatgcgacaccgttgcgggttaccgtgtgagccgctggaacgcagccacccaggcatacgaaccactgcacgtgggcctgctgccagcacagacacgtgactacacagacaccacagctgctcgcggtgcagcacacttttacacactgcaggctgttcgtgctgacggtagtgtggcaggcacctacgtttggtcttgtgtgtttcaggaccgcgttcaccaccaccaccaccactaataagaattc

SEQ ID NO: 538 - DNA, 1946 bp, Artificial Sequence
  Optimized for E.coli
ccatggctgtgacatgtgcatcaccggtttttaaacgtcagttttacgcgaacaccggcttttcaggtaccccgaagaaaaccgactgcgacagcgctattaacgaaaactggggtgccggtgctccagcttctggtctgccgagtaacaactttggcgttcgttggaccgtgacacgcgactttggtagcggtggcccgtttacctttacagcagccgcgcaggacggtattcgtgtttacgtggacggcaaacgcaaaattgacctgtggaaaaacgttagcagtacccagacaaaaaccctgaacctgacaattccgagtggtaaacacaccctgcgtgttgactacgtgaactggacaggcagtgcgaacgttaaatttacctacgcaccgcgcacctctgccacagttgacaaagtgaaaccgctggctccgaaaggtatttctgtggcctacggcaaagcgaccaacaaagctcgtctgacatgggcaaaaaacgccgaaatggacctggcgggttaccgcgtttaccgtcgcctgtctaccgcttcaacatggaccaaagtgggcaccacaaccgcgacctctacaaccgcttacacagactcaccgccggcgaccggtaaaagctacgtttacgaagtgcgtgcatacgacaaagccggtaacacaagcaccggcagtgcagacctgtcagttaccgcgattacactggctacaccgaccggtctgacagcaaccggtgcagacgctggtattgccgtgagctggcagccagttgctggtgctgtgaaataccgcctggcgcacgacgacagtggtgcttacacaaccgttacaggcacctcttacaccgactcttcagttgcgcgttctgtgtaccgctcatacaaagttgctgcagtggacgctagtggtcacgtgtctgcgtactcagctgttacagcacaagtgcgtcgcccggtggctgctccgtacggcatggttgcaagcgctgcaagtggtacaggcgtgtaccgtctgtacgtgaactggaccgttaacacagcaaccggtggcgcctacgacacatttcacgtgtaccgcagcaccagtctgccggttgacacaaccgcggaaccgtttgtgtgtgacgacctgtcatacaacattggtgacgacgaacgtggctacagctgccgcgacgaacaggttgcaccggccacaacctaccactacgttgtgaaaggtgtggacgacacaggcaccgaatctctgccgtcagcaaccgtttcagtggccacaccgaccccggacacaacagctccagctccagttacaggtctgacagcaaccccgacaaaatacggcattgaactggactgggccgacaacgcggaaagcgacgttgtgcgttacgttgtgtaccgcggtgtgccggcaggtgacggtgacggtcagagctgtggcagtctgggtcagattggcaccgcctttaaaagtcagtacacacacctgacactgccagacggtggccgtaactgctacctggttgacgcggtggacgacgctggtaactctgcttacaccgcaacaggccaggcaacaaccgttcacgtgaccgaactggacgtgcgcccgtctgttgcctcaccgaccgaaccgccggttacagtgaacggtttttacgacaccagttttggccgtgtggaactgtcttggaacgttcgctacccgtacgacacaaacaaatactacgtttaccgttggaacccggccacccaggcgtacgaaaaactgacaaccacaccgctgaccacaaaacgctactttgacaccacagcagaaccgggcaccacacacttttactgggttaccgtggcctacacaaacggtgaaagcgaaccgggcagtacctacgtgattcgccagccgcaccaccaccaccaccactaataagaattc

SEQ ID NO: 539 - DNA, 2198 bp, Artificial Sequence
  Optimized for E.coli
ccatggctgtgacctgtagcgcaggtgtttggaaagctcagtactacgcaaacaccacactgtctggcacaccgaaagccaccgtttgcgactcagccgtggcggaaaactacggctctggtgacccgtcaggcgttaccctgccgaacgacaactttggtgtgcgttggaccacaacccgcaactttggtagcggtggcccgtttgacctgagtctggctgtgcaggacggtgctcgtgtttacctggacggtagccgtaaaattgacctgtggcgcaacgttacaagtacccagcgtaaaacagtgcgcctgaccattccgcgtggtagtcacaccctgcgcgtggactttgcagcctttacaggcaccgcaaacattagctttagttacgctccggttattggtgcaacatacgacaaaaccgtgccgctgtctccggttggcgtgaaaagcagtttttctgcctcaaccctgaaaacaaccctgacatggtcacgtaactacgaaatggacatggctggctaccgcgtttaccgtcgcgtggcaggtacctcttcatggagcctgcgtaacagtacactgattaccggtacaacctttaacgaagcaccgccggctacaggtgctgcttacgaatacgctctgcgtgcagtggaccgctctggtaacgttagcccgctgagtgccgtgacctctgttgtgtcagctgaccgtacagctccagcagttccgacaggcctgacggcaacctacgacccatcagctggtgctcgtctggcttggagcccggcaagtggtgctagcagttacgaagttcagcgcgctgtggcaccggaaggtccgtttgcaccagttggtgcgccgctgcagggtgcagccctgaccgacccggcggctgcagttggcacaacctactactaccgtgtgcgcgctaaagacggcgctggtaacgcctctgcgtactcagctccagtgcgtctggacgctgctgaagctaaaccactgccgccgaccgctgttagcgcaacaggtcgtctggaccgcaacaccgtgggctggcagtacgacggtgacgctagccaccagtttcacgtttacggcgcagacagtgctgcaggtccgtggacacgcctgacagacaccccggttgctggtaccagctacgacgaccacgctgctccagtgggtgaagctcgttactaccaggttcgcaccgtgacaaccctgggtacagaaagcgacccgagtacaaccgctagtgcaacccgtattcgcgacgttacaccgccgcacatgccgtacggcctggacgcatgggacgctacagacggtgttcacctggtgtggacaccgaacaccgacgacacagaccactacctggtgatgcgtaaaacaatgtttggtgcctgggaacagattgcggttgtgcgcgacggcacctacctggacacaagcaccgcgccggacgttcagtttggttacacagttcgtgctgttgacggtgctggtaacgttagtccgctgccagaaccaggttacggtaccgtttacggcaaacgcctgccggtgtacgaaaaaccggctgcaccggcatctgtgacagccaccgcggacaacggtaacgttaaagtggaatggaccccgagcacaagtaccgacgttgctggctactacgtgtaccgtacaaccgttacagacccgacaaccgcatactctgtttcaccgctgatcactggtacaacctttacaaacgttgacgtgccggcaggcaactcatggtactacgttgtgcgcgttgtgtctacacactcacagtggagcgactacagtccgatggccgctgttacagtgccatgtccggttctgacaggtccgccgaccccgcgtattacaggtggcggtcgcggcgctgactacgcacagctgaactggcaagtgggtacctgtgaccagggtgctacagtttcttacaacgtgtaccgttcaacctcttcagcagacgtttttacaccggaacgtcgcattgctaccggtgtgacagcactgacctacaaagacccgggcctggctcgcgcatactactactacgttgtgaccgccgttgctgcagacggtacagaatctgccccgcaggcgaccccgtttggcatttcaatgatggcgccgcaccaccaccaccaccactaataagaattc

SEQ ID NO: 540 - DNA, 1169 bp, Artificial Sequence
  Optimized for E.coli
ccatgggctttattctggcagccgcggttctgtgtttcttttactttcgcaccgaagaaccggcggaagtggaccgtgaaattctgaacgctccggactttctgaaaaacaaagaagcactgctgtacttttctacagctgcagaccaggacacctttggtggcggtaaatcatacgctctgtttgcagacaagaaaggtcgtctgagcagttaccagatgaaaggcctggaactgggtagcgctaaagttcacgacggtagtgtgctgctggaagacaagaaaggtatttacaccgttcagaacggtctgcacacctacaaacgcacataccagcacaccggcgacagcgcaggttacattgaacgtacaaaaggcttttacaccctgtacaacagtggttacgacaaatctggcggttcataccgtagcgaactgtaccgccagattgacggccgttggaaacagaacgttattccgcactacattcgcgcctctggtttctttaaagaccacctgtttgcgctgaccccgacatacgacgaaaaaggctaccacattgaagacattcaggccgacaaagaaaaactgcacaccaaatcaattgcgacctggacatacaaagaaggtacaagtgtggaatctcagctggctgctgacgacggtgctgtttgctttgtgacccgtggtgaaaaagcagaacacatttaccagatggttaaagtgatgcgcaaaagcggcgcaattaaaacatacgacattgccacctaccgtaacgacgaacagacaatttacgacagtatgccgttctctttcaaaaaatctttctttatggaacgtcgcagtttttactttgttgacggctttggtacagtgtaccgcattaacccggaaaccggtaaaagcaagaaagcatttacactgccggcgtcacgtatgaaagctgactttaaagacctgacccaccagaacggcaaactgtacctgtttacatacagctacaaaaaaccggccaaaattgaaagttttgacctgaaaaccggtaaaaaactgaacgaccgtacaattccgtctctgcaggacattgtgtcaccgaaaagccacctgaaactgtacgacgttcaggtgatggacggttttcaccaccaccaccaccactaataagaattc

SEQ ID NO: 541 - DNA, 1997 bp, Artificial Sequence
  Optimized for E.coli
ccatggctgttacatgtaccagtccggtgtggaaagcacagtactttggtaacagcacatttagtggcaccccgaaactgacagcgtgcgactctgctatttcagaaaactacggttacggcgacccgacaggcgttaccctgccgaaagacaacttttcagtgcgttggagcctgacacgcgactttggttcaggtggcccgtttcgtctgagcgcagccacccaggacggcatgcgtgtttacgtggacggtgttcgcaaaattgacctgtggaaaaacgtgagcaccacagcccgtaaaaccgttgacctgacggtgccagctggtaaacacaccctgcgtgttgactacgtggcatggacaggtaccgccaacgcggcttttacctacgctccgcgcacagaagcagccgttgacaccgtgaaaccactggcaccaacaggcctgacagctgcttacaaccgtgacaccacaaaaaccacactgcgctgggcagccaacaaagaaatggacctggcaggttaccgtgtttaccgtcgcctgagtacaacccagtgggctcgtgcaggtggtccatctctgctgacctctccgtcatttgtggacaccacaccggccaccggtcagacctttctgtacgaagttcgtgcagtggacaaagctggtcgtgaatctgctggcagtccggacgcaacagttgccaccgtggaccgtacgggtccagctgctccaacaggcctgcgtgttacaagtgacgcgtggtgggctacactgtcttggcaggcaggtgcagacgcagccaaatacgaagtgtacgcggctagtgcagccaccggtccgtttgaactgctgggcaccacaaccacaacctcttaccgtaccgacgcgccgatgaacacagctcgctactaccgtgttcgcgcactggacgccctgggtaacccgtcagcgtacgctacagttacaggtgacggtgtggaccgtaccccgccgaaatctccgacatcactgggcagcgttgtgggttttggctacaccgacgtgtactggaaccagccggacggtttttacgaagactttgacaacggtggcacctaccacgtttaccgtagcacaggcaaaacactggacccggctgctctgacacgtgtgacctgtgcagaagaaagtgacgaaacatctaccggtggcaaatgccacgacctgggtatgccggcaggcacatacgttacatacgctgttgcagctgtggacccagctggtaacgaaagtgctctgtctgctccgctggttgtgcgtacaggtgaccgcgttgcaccaggtccagttaccggcgtgaaagcgacaccgcgtaccgacggtgttctgctgtcatgggcggctagcaccgacgacgacgtggaaagttacgttgttcgcaacggtacacgccaggctgacggtacaattcgttggctgggtaccagcagttgttgggaaggcacatctgacccgctggctgttctgtgtggtgacgtgccagacggcgaaacctacgtttactcagttgtggctcgtgaccgctggggtaacgcactgctgccgagcgacccgaaagttaccgttgtggaagccacagaactggacgtgcgtccgagcgttacagtgacccgcgactgggacctgggtagtatgggctacgactctctgattggtggcccgggtgttaaaggcccgtcaattaactggcgttgtgacaaaaccgcagaatgcgacacagttgccggttaccgtgtgagccgctggaacgcagccaccaaagcgtacgaaccactgcacgctggcctgctgccagcggaaacccgtgcttacacagacacaaccgctgttcgcggtacaacctacttttacacactggaagcagttcgtgccgacggttcagtggcaggcacccacgtttggagctgtgtgctgcaggaccgcgtgcaccaccaccaccaccactaataagaattc

SEQ ID NO: 542 - DNA, 1946 bp, Artificial Sequence
  Optimized for E.coli
ccatggccaccacatgtgcagccggtgtgtggaaagctagctactacgcaaacaccacatttgctggcacaagtaaactgaccgtttgcgacacagcaatttcagaaagctacggtacacgtgacccggccggcgtgacactgccacgcgacaactttggtgttcgttggacaatgacccgcaactttggctctggtggcccgtttaccttttcagttgccgtgcaggacgcggttcgtgtgtacctggacggcacccgcaaaattaacctgtggagcaacgttagcagtacccgtagtaaaacagttaacgtgaccgttccgaaaggtacacacaccattcgcgtggactttgcggcttttaccggttctgctaacgttaaatttggctacgccccgaaaacatcagctacagttgacaaaacagccccgctggctccaacaggtgcacgtgttagctacgaccaggcttcttcaaaagcaacattcacctggagtaaaaacaaagaaatggacctggcgggttacaaagtgtacctgcgtcgcccgggcacatctaccctggttgtgcgcaccacagctacctcatacaccacaaccctgccggctacaggtgcagtgtaccgttttggtgtggacgctgttgaccgtgctggtaacaccagcagttctggcattgacctgccggttacaacagcagaccgtacagccccgcaggctccaattggcctgacagcagccgacagtcagtgggacgtgacactgtcatggaccgctagcgaagcaggtagtacctttcgtgtgtaccgcgccgacagcacaaccggtccgtacagtctggttggcacaaccaaatctacctggctgacactgaccgacgcgccgtactcaacaccgcgtcactacaaagtgacagctaccgacgttagcggcaacaccagtgcggcttctgctgtgctgagttacacacgcccgaccgcagttccgtggctgtaccacgctgaaaacaacgaagcagacaccggtattcgtctgctgtgggaagctcgcctgaacgcaggtacaaccggctttcgtgtgtaccgtgctgaaccgggttctgctgacccatcatggcacgctgttacctgtgaagactttggtcagggtggctctacaccgtacgtgcaggttcactactgcaccgaccgttcagctgttgcacgcacagcctaccagtacacagtgaccagcgttgacgcgaaaggtcgtgaatcagaacgcagcgtgccgtacagtattacgcgcgttgaccgtaccccgccgccggcagtgacaggtgttaccgccaaagcgaccccgtacggcgttgtgctggactgggacccgtctacagccccggacattgcgaaatttattattcgtcgcgaaccggaagaaaaactgccgtgttggtgcaacctggcagaagtggacgcagccacaacccactttgttgacgccgaactgccggacggtgaaacactgacctactcagtggacgcagttgacaccagtggcaactctctgtacacactgtacctgaacccggaagacgagggtatgacatttgccgacgtgaccgaactggacctgacaccgtcagttgacaccccggctggtgcaccgctggacctgacggctacagctgctgactctggtcacacagtggaactgcgttgggacgctattggtgaagcaacaggctaccgtgtgcaccgctggaacccggacgcagctgcgtacgaaccgctgacagccgaaccggttaccgacctgagctacacagacacaaccgctgcaaccggcacaacccacttttactgggtgaccgccgtttacgctgacggtacggaatctgctccaggtgctgcttggaccattctgcagccgggttctcaccaccaccaccaccactaataagaattc

SEQ ID NO: 543 - DNA, 1988 bp, Artificial Sequence
  Optimized for E.coli
ccatggcggtgacctgtacaagcccggtttggcgtgctcagtactttggcaactctaccttttcaggtacaccgaaactgaccgcatgcgacacagccattagtgaaaactacggttacggcgacccggcaggcgtgaccctgccaaaagacaacttttctgttcgttggtcactgacacgcgactttggttctggtggcccgtttcgcctgtcagcagccacccaggacggtatgcgtgtgtacgttgacggcgttcgcaaaattgacctgtggaaaaacgtgtctaccacagcacgtaaaaccgttgacctgacaattccggccggtaaacacaccctgcgcgtggactacgttgcctggacaggcgcggctaacgcagcctttacctacacaccgcgtaccgaagcggctgtggacacagttaaaccactggctccaacaggcctgacagcagcctacgaccgtaccacagctaaaaccacactgcgctggaccgcaaacaaagaaatggacctggccggttaccgtgtgtaccgtcgcctgagcgcgaccagttgggctaaagtttctggcacatcactgctgaccacacgctcatttgtggacgctccgccggcaaccggtcagacatttctgtacgaagtgcgtgcagttgacaaagctggtcgtgaaagcacaggtagtccggacgtgacagcaaccacagtggaccgtacaggtccagctgctccaaccggtctgacagttgccaccggtgacggttggtgggacaccctgaactggcagggtgtggccgacacagcgaaatacgaagtttacgcaagcagtgcagccgcgggcccgtttgaactgcgtggtaccacaaccacaaccagctaccgcaccagtggcgcggtgaacaccaacacatactaccgtgttcgtgctctggacgctgcaggtaacccaggtgcttacgcaaccgtgacaagcgacggtgttgaccgtatgcctccgaaaagtccaacaggtgtgacagctggtgcacgtccgggttacaccaacgttcactggagccagccggacggcttttacgaagactgggacaacggtggccactaccgtgtttaccgcagtccgggtaaaacctttgacccgacagcgcgtacccaggtgacatgtgttgcggaagaatctcacgaagcttcaaacggtggcaactgctacgacgtggacatgccggctaacacctacgttacatacgctgtgaccgcagttgacccgtacggtaacgaatctgcctactcagcgccggttgtggttcgtacaggtgacacagtggctccaggtccagttaccggtgtgaaagttacaccgcgcaacgacggtatgctggtgagctgggccgcgagtccggaagacgacattgacgaatacgttgtttggaccggcgtgcgtcaggcagacggtacagttaaatggctgggcccggctacctgtgcagaaggcacaagcaactggctggcaattctgtgtggtaacctgccggacggtgaagcacacgtgtacgccgttaccgcgaaagaccactggggtaacacactgcacccgtctgacccgaaagtgaccgtggttgaagccacagaactggacgttcgtccgtcagtgaccgttacacgcgactggagcctgggtagtctgggccacaaccgtacaaccacacgcccgtctgttgactggcagtgtaccgacaccacacgttgcgcgaccgtgacaggttaccgtgtttcacgctggaacccggctaccaaagcatacgaaccacagcacgacggcctgctgccagctgacgcacgtacatgggaagacgccaccgcgacaaagggtaacacctacttttacaccctggaagctgtgacagctgacggtgctgtggttggtacctacccgtggtacacagtgtttcaggaccgtgttcaccaccaccaccaccactaataagaattc

SEQ ID NO: 544 - DNA, 1955 bp, Artificial Sequence
  Optimized for E.coli
ccatggcagttacatgtacctctccggtgtggacagcacagtactttgccaacaccagctttagtggtacaccgaaactgaccgcgtgcgacagcgctattgcagaaaacatgggtagtggcgacccggctggtgtgacactgccgaacgacaacttttctattcgttggtcactgacacgtgactttggtagcggtggcccattccgtctggcagcagcgacccaggacggcatgcgtgtttacgtggacggtgttcgcaaaattaacctgtggacaaacgttagtaccacagcgcgtaaaaccgtggacctgaacattccggctggtcgtcacacaattcgcgttgactacgtggcatggacaggttctgcctacgcgggctttacatacaccccgcgcacagaagcatcagttgacaccgttaaaccgctggcaccaacaggcctgacagctgcatacagccgtgacacagcgaaaaccacactgcgctggaccgcgaacaaagaaatggacctggctggctaccgtgtttaccgtcgcctgtctaccacaccgtgggcaaaagtgtcaggtagcagtctgctgaccacaccgagttttgtggacaccccgccggcaaccggtcagacctttctgtacgaagttcgtgcggtggacaaagctggtcgcgaatctacaggctcagttgacgtgacggctgctacagttgaccgtacaggtccagctgcaccaacaggcctgaccgttgtgagtgacgcctggatggcgacactgagctggcaggcagttagtgacgccgcgacctacgaagtgtacgcctcttcagctgcaacaggtccgtttgaactgctgattaccgcaaccacaaccagctaccgtacaagtgcaccgaccaacgccaaccagtactaccgcgtttacgctacagttgcaggtgacggtgttgaccgcaccccgccgggttctccgtcaggcctgaactctgttgcacgtccgggttcaacggctgtgtactggacagctccgggtggccgttgggttgaagactgggacaacggtggccactaccgtgtgtaccgctctccgggcaaaacatttgacccagctgctcgtaccgaagtggcttgtgcagaagaaggttcaaacgaagctggtaacggtggcgcctgtgttgacctgggtatgccggttaacacatacgtgacctacgccgttacagctgtggacccagacggtaacgaaagcgcttacagtgcaccgctggttgtgcgtacaggtgacacagttgcaccaggtccagtgaccggcgttaaagtgattccgcgttctgacggtatgctggtttcttgggctgcatcaccggaagacgacattgacgaatacgttgtgtgggctggtgctcgccaggctgacggtacagtgaaatggctgggtccggaccgttgttgggaaggcgtttcaaacccgctggctattctgtgcggtaacctgccggacggcgaaacccgtgtttacgccgtgattgcgaaagaccactggggtaacggcctgcacccatctgacccgaaagttattgctgtggaagcaaccgaactgaacgtgcgtccgagtgttacagtgacccgcgactggaacctgggtagcctgtctcacaacccaacagctgcgcgcccgagcgttgactggcagtgtaccgacacaacccgttgcggtacagttacaggttaccgtgtgagccgttggaacccagcgacaaaaacctacgaaagtcagcacgacggtctgctgccagctgacgcacgtacatggaccgacctgacagcaaccaaaggcaacacatacttttacacactggaagctgtgacagctgacggtgctgttgtgggtacatacccgtggtacaccatttttcacgaccgtgttcaccaccaccaccaccactaataagaattc

SEQ ID NO: 545 - DNA, 2840 bp, Artificial Sequence
  Optimized for E.coli
ccatgggtcaccaccaccaccaccacgacgacgtgatggcaatgaactaccacgttcagggcgaccgtatttttctgagtggtgacgtgacatacgcggacgttgtgtctctgccggctctgctggcgaaagctcaggcagaaggtcgtccggttcgcgaagttgtgctgcgcacctctaacggtggcgcgctgattgctggtgaatggctgcagggcattattcgtacatcaggcctgaacaccattgtgagcggtaactgtattagcagttgcagtattatgcagtctggtggcgttgaacgctacctggccggtgacctgccgctgattgactcagtgcagattcacgcagcctcttcaggtggcaaagttatttacaccccgagcccgcgtatgacccagatttacacaggcaactacggtggcggtatggacgcgggtctgctgcacaaagctatgtacgaagttgtgaaaccgaacggcctgctggtgtttcgtgacccggctcgctcaacaggtagcagtgttacctttgacccggacggtagcggcagtaaactggaatcatttccgggtcaggacatttacagcaaccgcattattacagcgaacggttaccgtgacccgggcgacaccctgaacgtgacagctaacgttaccggtgacattaacccaggttacctgcgtacaggtcgtcagctgcaggcatttgtggacgacgactttgcccgttggaacacagactggcgcagtacctacattaacctggcacagtctatttacaacgcctcttcaaaaggcccgcagggtattggcgccctgagtgtgcagggttacctgtctgacccggacattcaggacctgctgctgtcaaaactgcgtctggccgacctggacgttagcacactggacaacgcgatgggcgtgattcgcgttaccaacggtgctacctggcgtacaagcgcgaccacaggcgctgactttatgctggttgacaacggtaccattgcgctggaaggcggtgcactgcgtgccagtgaagtgcgcgttctgggtgctggcatgctggttggtcacggtgacgttgctggtacagctatggaccgtgctgctctgctggacggtacaggtccgagctaccgtgaagacggctttaaccgtctgcgcgtgtttggtacactgatgccacgcggcggtgacctggtgacccacggttacgttaacattatgccgggcggtaaagtgctgtttgacgttacagaaaacggcggtacagcagctggccgtctgcgtgttggtacctttttcgacgacgaacagaccgaaggcgcgctggtgattagtaaaggtgcttttctggaactgaacgttgcacagggttactacggccaggactttcgtcgcgacctggtgaaaggtccgatttaccagggcggttttgaagaagcagttcgtctgggtgacaccggctactctgcctcaattagcggcgacgtgtttcgtccgcgccacaactcactgctgagctttaacgttaaacagacagctgacggtctgtggctgacagctaacccaggctttgaccagctgggtctgtttgcaaacggcacaagcggtgacggcctgggtcgtgcactggctacagcttcagaccgtcaggacaaaggcctgcgcagcctgctgggtgcactgcagtttgccgaccgtgacgtgattgcccagcaggcaggtgcactgcgcggcgacgctcacgcttcactgcgtctggcagacaccgccctggttggtagcattggcaacgttgtgcagcagcaccagtcagcaatgcgcagcggcggtgacgctgacggcctggcttcacaggtggcacagagcgttagcagtcagccgggtatgcgtcacggctctctgtttaaccagctggctatgcacctggtggaaccagctccaggtagtgttgcaggctctggtgacgccggtcgtagtcacggcatttgggcccgcggttttgcgtctcacggccgtattgacgcgggcggtggcgtggctggcctgtcacacaacattggtggcgttgtggttggtgcagacacacgtgtggccgacgaccgcgttaccctgggtgtgagtgttgcggctgcagacatgtctacaaaagcgagtgacggctctggttttacaggtgacgtgcgtgctctggacgttggtggctacctggacgcgacatacgctcgtggttacctgagtgccgcggttcgttacacagacctgcgccacgacacccgtcgctctattggtggcattgacggtctgcagcagccgctgcgcgcaaaatacagtaacgacgcaatttctgcccgtgtggaacacgcctttagttttaccaacggcaaaggtctggttattcagccgctgctgccggtggttgactacgctcgtacctctgcaacacgctttaacgagggtcagggtgcaggtgccctggtgggtcgcagtggctctctggaatcaattcgtgttggtgcgggcctgcagctgtttaaaacatttgagggtaacaacggcgaacgcattaccccgcgtgcacgcgtggtttggcagaaagaactgggcgactcacaggcccgttacagcacaggttttgctgcagccccggacctgatgtttggcgcctcttcacaggcggtgggtgaacaggttctggcatggaacctgggtgttacctcacgtgctagcgaacgcctgagtattatggcagactacgtgggtgaacgtcgcgacggccagattcagaacggtgttatgctgggtctgggctaccgtttttaataagaattc

SEQ ID NO: 546 - DNA, 1997 bp, Artificial Sequence
  Optimized for E.coli
ccatggccgtttcttgtacctcaccggtgtggaaagcgcagtactttggtaacagcacctttagtggcacaccgaaactgaccgcctgcgacagtgcaattgccgaaaactacggttacggcgacccgccgggtgttaccctgccaaaagacaactttagtgtgcgctggagcctgacacgtgactttggctcaggtggcccgtttcgtctgtctgcagcaacccaggacggtatgcgcgtttacgtggacggtgttcgtaaaattgacctgtggaaaaacgtgtcaaccacagcccgcaaaacagttgacctgaccgtgccgagcggtaaacacaccctgcgtgttgactacgtggcgtggacaggtaccgcgaacgctggctttacatacgcaccgcgcacagaagccggcgttgaccgtgtgaaaccgctggctccgacaggttttaccgcggcttacaaccgtgacacccgcaaaaccacactgcgctgggcagccaacaaagaaatggacctggcaggctaccgtgtttaccgtcgcctgagtgcgacccagtgggctaaagtgtctggtagcagtccgctgacatctccgtcatttgttgacgcaacaccggccaccggccagacatttctgtacgaagttcgcgcagtggacaaagccggtcgtgaatctgcgggctcactggacgctaccacagttagcgtggaccgtacgggtccggcaacaccgacaggtctgacagttgctggtgacaactggtgggctacactggcttggcagggtccagcagacgctgctaaatacgaagtttacgcagccagtgcggctacaggtccgtttaccctgctgggcaccacaaccacaacctcttaccgcacagaagcgccggttaacaccctgcgttactaccgtgttcgcgctctggacgtgtcaggtaacccgagcgcatacgcagctgttacaggtgacggtgtggaccgtacaccgccggcgaaaagcccgaccagtctgggttctgttgtgaacgttggcgacaccgaagtgtactgggaccagccggacggcttttacgaagactttgacaacggtggctcataccgtgtgtaccgcagcccgggtaaaacactggacccagctgctctgaccggtgttacatgtgcagaatggagtgacgaaacatctaccggtggcaaatgtcacgaccgtgacatgccagctggtacctacgtgacatacgctgttgcagccgtggacccggctggtaacgaatcagcactgtctgccccgctggttgtgcgcacaggtgaccgcgttgctccgggtccagttggtggcgtgaaagctaccccgcgtgctgacggtgttctggtgtcatgggcggctagcacagaagacgacgtggaacgttacgttgtgcgcaacggtacacgtcaggctgacggcaccgttaaatggctgggtacagcaagttgttgggaaggtacctctgacccgctggcagtgctgtgtggtgacctgccggacggcgaaacatacgtttacgcggttgttgctcgtgaccgctggggtaacgcactgagcccaagtgacccgaaagtgacagttgtggaagcgaccgaactggacgttcgcccgtcagtgaccgttgtgcgtgactgggacctgggcagtctgggtcacggctctctgattggtccggaacaggacggtccgagcattggctggcgttgtgaaaaaacagcagtttgcgacaccgtggccggttaccgtgttggccgctggaacgcagtgaccaaagcctacgaaccactgcacgctggtctgctgccagctgaaacacgtgcttacaccgacacaaccgcagcccgtggcgcaacacacttttacaccctggaagcagtgcgtgctgacggtagcgtggctgctacctacgtttggaactgtgtgtttcaggaccgtgttcaccaccaccaccaccactaataagaattc

SEQ ID NO: 547 - DNA, 1997 bp, Artificial Sequence; identical to SEQ ID NO: 546
  Optimized for E.coli

SEQ ID NO: 548 - DNA, 2849 bp, Artificial Sequence
  Optimized for E.coli
ccatgggtcaccaccaccaccaccacgcagtggacgacgttatggccatgaactaccacgtgcgtgacgaccgcgtttttctgagcggtggcgtgaccgttgctgacgttgtggcactgccggccctgctggctaaagcacaggccgaaggtcgtccgattcgcgaagttgtgctgcgtacatctaacggtggcgcgctgattgctggcgaatggctgcaggcagtgattcgcacccagggtctggacacaattgtttcaggccactgtattagcagttgctcaattatgcagagcggtggcgtgaaccgttacctgggtggtgacctgccgctggttgacagtgttcagattcacgcagcctcttcaggtggccgtattacctacgcaccgtctccgcgcatgacccagatttacaccggtaactacggtggcggtatggacgctggcctgctgcacaaagctatgtacgaagttgtgcagccgaacggtctgctggtgtttcgtgacccggcacgtaccacaggtaccagtgttacatttgacccggacggctctggttcaaaactggaaacctttccgggtcaggacattcgtggcaacaacattattaacacggctggttaccgtgacccgggtgacaccctgcgtgtgacatctaacgtttcaggtgacattaacccaggttacctgcgtacagctcgtcagctgcaggcatttgtggacgacgactttgcacgttggaacaccgactgggccagcacatacattaactacgcggtgtcactgtacaacgttagcacccgcggtccgaacggcattggtacaccgagtctgcagcagatgctggctgacccagacctgcaggacgaactgcgtggtcagctgcgtctggctgacctggacgcttcaaccctggcaagcagtgccggtgtgattcgtgttagcaacggtgcaacctggcgtacagctgaaaccacaggtgctgactttatgctggttgacaacggcaccattgcactggaaggcggtgccctgcgtacaccggaactgcgtgtgatgccgggtagcgttgtggttggccacggtgacattgccagtgttggtacagactctgacgctctgctggacggtacaggtccgagttaccgtgaagacggttttaaccgtctgcgtgtgtttggtacactgatgccgcgcggcggtgacctggtgacacacggttacgttaacattatgccgggcggtcaggtgctgtttgacgttaccgaaacaggcggtacaggttctggtcgtctgcgtgttggtagtttttacgacggcggttctgaagaaggtgcgctggtgattgcgcagggcgctcacctggcactgaacgttgcgcagggtttttacgctggcacctaccgtcgcgacctggtggaaggtccgatttaccagggcggttttcaggacgctgttcgtctgggtgacacaggctacagcgcaagtattgcggctggtgaagtgtttcgtccgcgccacaacagcctgctgagttttaacgttaaccagaccgctgacggcctgtggctgacagcaaacccgggttttgaccagctgggcctgtttaccaacggtacaagtggtgacggtctgggccgtgcactggcagcagcttctgaccgtcaggacagtggtctgaaatctctgctgggcgctctgcagtttgcagaccgcgacgttattgcacagcaggctggtgctctgcgtggcgacgcacacgcaagtctgcgtctggcagacaacgctctgattggttctattggcaacgtggttcagcagcaccaggctgcaatgcgcagcggcggtgacgctgacggtctggcgtcacaggctgctcagagcgtgtcttcacagccgggtatgcgccacggctcactgtttaaccagctggccatgcacctggttgaaccggctggtgaaggcgcaggtgacagccgtacagcttctggttcacgtggcctgtgggcacgcggctttgcttcacacggtcgtattgacgcagacggcggtgtggctggtctgtctcacaacgttggcggtattctgattggtgctgacacccgtgtggctgacgaccgtgttacactgggtgtgtcagttgctgcagccgacatgagcaccaaagcatctgacggctcaggtttttctggtgacgtgcgtgcactggacgttggcggttacctggacgcgacatacagtcgcggctacctgtctgcggctgtgcgttacaccgacctgcgccacgacacacgtcgctctgttggcggtattgacggtctgcagcagccgctgcgtgctaaatactcaaacgacgctattagcgcacgcgtggaacacgcatttagttttaccacaggcaaaggtctggttattcagccgctgctgccggtggttgactacgctcgtacctctgcaacacgctttaacgagggtcagggtgctggtgctctggtgggtcgtagcggcagtctggaatcagtgcgcgttggtgccggcctgcagctgtttaaaacctttgagggtaacaacggcgaacgtattacaccgcgtgcccgcgtggtttggcagaaagaactgggtgacacccaggcgcgctactctacaggctttgctgctgctccagacctgctgtttggtgcaagcagtcaggcggtgggcgaacaggttctggcgtggaacctgggtgttaccagtcgtgcttctgaacgcctgtcaattatggcagactacgtgggcgaacgtcgcgacggtcagattcacaacggcgttatgctgggtctgggctaccgtttttaataagaattc

SEQ ID NO: 549 - DNA, 1997 bp, Artificial Sequence
  Optimized for E.coli
ccatggcggtttcttgtgcttcaccggtgtggaaagcccagtactttggtaacagcacctttagtggcacaccgaaactgaccgcatgcgacagtgccgttaacgaaaactacggttacggcgacccgacaggtgttaccctgccgaaagacaactttagtgtgcgttggagcctgacacgcgactttggctcaggtggcccgtttcgtctgagcgcagccacccaggacggtatgcgcgtttacgtggacggcgttcagaaaattaacctgtggaaaaacgtgtctaccacagctcgtcgcacagttgacctgaccgtgccggcaggcaaacacacactgcgtgttgactacgtggcatggacaggtctggcacacgctacatttacctacgcaccgcgtgcggaagcggctgttgacaccgtgaaaccactggctccaacaggtctgacagcagcatacaaccgtgacaccgcaaaaaccacactgcgctgggcggctaacaaagaaatggacctggccggttaccgtgtttaccgtcgcctgggtaccacacagtgggtgcgtgcgggtggcagcagtccgctggcttctccgtcatttgttgacgctacaccggcaaccggtcagacatttctgtacgaagttcgtgcggtggacaaagctggtcgcgaatctgtgggctcactggacgctaccgcagttacagttgaccgtacaggtccggcagctccgacagctctgacggtgacaggtgacgcatggtgggctacactggcttggcagggtgctgctgacgcagcaacatacgaagtgtacgcggcttcagcagccaccggtccgtttgaactgctgggcaccacaaccacaaccagctaccgtacagacgcaccggttaacaccgcccgcttttaccgtgttcgtgcactggacgcactgggtaacccatcaccgtacgcaagcgttacaggtgacggtgtggaccgtacaccgccgaaaagcccgaccagtctgggttctgttgtgcgcgttggctacaccgacgtgtactggaaacagccggacggtttttacgaagactttgacaacggtggcacataccgtgtttaccgcagtccgggtaaaacactggacccagctgctctgacccgtgtgacatgtgctgaagaaagtgacgaaacatctaccggtggcctgtgccacgacctggacatgcctgcaggcacctacgttacgtacgctgttgcagctgtggacccagctggtaacgaatcagcgctgagcgctccgctggttgtgcgcacaggcgaccgcgtggctccaggtccggttaccggcgtgacagcaaccccgcgcgctgacggtattctgatgtcatgggcggctagcaccgaagacgacgttgaacgttacacagtttggaccggtgcacgtcaggctgacggtacagttaaatggctgacaaccgccagttgtcgtgaaggtacctctgacccgctggctgttctgtgtggtgacctgccggacggcgaaacctacgtgtacgcggttgtggctcgcgacctgtggggtaacgcactgccgccgtcagacccgaaagttacagttgtggaagcgaccgaactggacgtgcgtccgagtgttacagtgacccgcgactgggacctgggttctctgggtcacggcaccgtgattggtggcccggacgaagacggcccgagcattagttggcgttgtgacaaaacagcggaatgcgacaccgttgctggttaccgtgtgagccgctggaacgcagccacacaggcatacgaaccactgcacgctggtctgctgccagctcagacccgtgcttacacggacacagctgctgcacgtggtacaacccacttttacacactggaagctgtgcgcgctgacggtggcgtggcaggtacctacgtttggaactgtgtgtttcaggaccgcgttcaccaccaccaccaccactaataagaattc

SEQ ID NO: 550 - DNA, 1997 bp, Artificial Sequence; identical to SEQ ID NO: 549
  Optimized for E.coli

SEQ ID NO: 551 - DNA, 1994 bp, Artificial Sequence
  Optimized for E.coli
ccatggtgacctgtgcgagtccgctgtggaaagctcagtactttggtaactctaccttttcaggcacaccgaaactgaccgcgtgcgactctgctattgcagaagactacggttacggcgacccggcaggtgttacactgccgaaagacaactttagtgtgcgttggagcctgacccgcgactttggctcaggtggcccgtttcgtctgagcgcagccacccaggacggcatgcgtgtttacctggacggtgtgcgcaaaattgacctgtggaaaaacgtttcaaccacagcgcgcaaaacagttgacctgacagtgccagctggtcgtcacacactgcgtgttgactacgtggcttggacaggtgctgctcgtgcagcctttacatacgctccgcgcaccgaagcggctgttgacacagtgaaaccactggcaccgaccggcgtgacagcaacatacgacccaggtaccacaaaaaccacagttcgttggaccgcgaaccaggaaatggacctggctggctaccgcgtttaccgtcgcctgggttctacatcatgggctcgtgtgggtggcgctagcccgctgaccagccgcagttttgttgacgctacaccggcaaccggtcagacatttctgtacgaagttcgtgcagtggacaaagctggtcgtgaatctgctggcagtctggacgcaaccgcggttacagttgaccgtacaggtccagcagcaccaaccggtctgacggtggttggtgacgcatggtgggctacagttgcttggcagcgtgtggctgacgcaaccacatacgaagtttacgcatctgctgctccggctggtccatttgctctgctgggtaccacatctaccacatcataccgtaccgacgccccggaaaacaccacacgctactaccgtgttcgcgcactggacgccctgggtaacccgtctgcctacgcgaccgttacaggtgacggcgtggaccgtacaccgccgaaaagcccgaccagtctgggttctattgcagacgttggcgccacacgcgtgtactggaaacagccggacggtttttacgaagactttgacaacggtggcacctaccacgtttaccgttcttctggtacggtgctggacgcagctgctctgacccgcgtgagttgtgccgaacagtcagacgaaaccagcacaggtggcatttgccacgacctggacatgcctgaaggcgcatacgttacatacgccgttgctgcagtggacccggccggtaacgaatcagcgctgtctgctccgctggttgtgcgcacaggcgaccgcgtggctccaggtccggttacaggcgtgaaagcgaccccgcgtgctgacggtgttctggtgagttgggccgcgtctccggaagacgacgttgaacgttacaccgcatggacaggtgttcgccaggccgacggcacagtgaaatggctgggttcagcattttgtcgtgaaggtaccagcgacccgctggcagtgctgtgtggtgacctgccggacggcgaaacctacgtttacgcagttgttgcacgtgaccgctggggtaacgcactgctgccgggtgacccgaaagttacactggtggaagccaccgaactggacgtgcgtccggaagttaccgtgacacgcgactgggacctgggtggcacaggttacggcaccgttattggtggcccggaagaagacggtccgtcaattacatggcgttgtgacaaagctgcagtttgcgaaagtgtggcgggctaccgtgtttctcgctggaacgccgcgaccaaagcttacgaaccgctgcactctggtctgctgccagctgcaacccgtacatacacagacaccacagctgctcgcggcgcaacatacttttacacactgcaggctgttcgtgcagacggtggcgtggcaggtacccacgcatggtcttgtgtttttcaggaccgcgtgcaccaccaccaccaccactaataagaattc

SEQ ID NO: 552 - protein, 244 aa, Artificial Sequence
  Optimized for E.coli
MAPAAATEPAPFSCLDPSGEALWSGPQCDGVIVRELGTEAVAILLDGRRIDFADEAELRADDCAVRPAVTLPASTFENLPKGPDPLYAAVDRRVDVPRIIPEPQWRKNCHPLFRSDGRDPSVIFEEGFGPKDTVNGQYDITSYVLQNQPSPFVSTTYDPELYKKWKKVPWDYFIDAPGGIDVNATIGDQHQYADQVEVAFPGGVDRHFIRRACPVDRATASLVEAGCVDNPNYQPWLHHHHHHH

SEQ ID NO: 553 - protein, 2462 aa, Artificial Sequence
  Optimized for E.coli
MGLIAAVVQVPVIAAAADGEFKLPSVQHIESVPLSRVTGDRPDTGAAQPPTAPPASAWPKPGKTEIDLPAVSAQQPSSQAKAPGLPLTVSSVGPTPAAGEPSKVRVGLSDRAAAATVGLDGLLVNLEPVAGSAAPDKARVQLDYKAFRESFGADWGSRLTFVQLPACALTTPDQPQCRSATPLAASNDTKAGTLTAEVAVSAPAGQVSADGQASSGGTVKASFTQASEASAAAATVLAATAGASGPEGDYKATSLSPSSTWSVTGNTGSFTWSYPIQVPPVPGGMAPKIALGYTSAAIDGRTASTNNQSSWIGDGWDYNPGFIERNYTPCVGDTGPGSNAPATSGDLCWKSDNATISLNGNASALVRDDASGTWKLSNDDGSRVEKLNGNTTDTANGDTDNEYWKVTTTDGTQYLFGKNRLPGWTTGKPETGSALTVPVFGNQPGEPGYAPAFKDSSRDRAWRWQLDYVVDPHGNAIAYFYGQEKNAYAKNIGAATGTPKADALYTRAVTLNRIEYGHRAGQVYNTPPAGKVTFSTADRCVAADCSFTKANAGNWYDTPVDQSCDKDQDCRNGAPTFWSKKRVTGISTQALQSNGSYRDIDAWSLDQDFPATGDSGGRALWLKTITRTAKAGAAAQTLQPVTFGGDLRPNRVDSAEGRPPMNRYRVNRITSETGSNTDIKYTDIDCVAGALPAPDSNTRRCYPSWWTPEGAVDPVLDWFHKYLVDTVTEHDMVAGSGSPDKVTGYEYLDGAAWRRDNSEFTPDKERTWNDFRGYQRVRTRVGASDKSLAETVYFRGMDGDTLANGQPRPASPLQGVKDSNELAGYVRESTVYDKDGGKPLTSTASTPWVRGTASRATKALPSQDGKPTATPPGESGRPQVAALPPLTAAMVRTESETTKAFQPDGGTARTTRLSRTFDDYGQIRTVSDEGDTNISGDEQCTRTAYVTQDTANWLIAYPQSVQITSTLCSTNATAATVTSETRTAYDGRPVGTAPEPGKGYATTVQALDRYDGATPHYLTATTTAYDQYGRVISVKGANNAETTTSYTPAGGSQPTLVQSTNAKKFTTTTAYDGLRALPVKVIDANNRTIHVDYDAMGRTTAVWNAGRDKSASPSATYTYTIEPGRQPAVTTRTLLEGGDYHTSIALYDGLLRPRQVQDEAHGGSTAHNGGRNITDSFYDSHGRAYRANAAYHADGAPEAALWIGLDNKVPSQTETEFDGLDRPTASIFKSLNVEKWRTVTRYGLNWVATTPPDAGTSTLTVADAHGRPSEVRHYKTGSPDYDAPASAYETLKYTYDSAGKLAKLVDPAGNAWTWEYDLLGRQTKTVDPDKGTTTSAYNADGTLATVTDARGRTLAYTYDVLGRRTGMFDGSTSGTKLAEWAFDSLPGSNGLATGSTRFENGKAYITGITGFDGAARPTGTTVTIPDSEGLLAGTYTAAQTYTPNTGLVDNTTYPAGGGLPQETVRRNYTPLGLPTTVSGGSRVYSLGNTYSPLGQLQQSVTGDIGSRAVQTYDYENATQRLAVVQTDRERSGPQTLEKKTYTYNPVGNITRVRDARDNAAVTDTQCYTYDFAQRLTNAWSATDDCVAKPTPTTDPYVGGVDPYWTSYTYDAAGNRTQATDRTFGAAPGPLMDTTKVTSVAIAGDGQTTAVAIADGQVHIAQQRTDGTWANFENLHRTQAGSLPAPVDYVAAAWADNTLQIMAVAGGRIWHTLRGADGRWGAWGDVTSVVGSIANPSQLSLSATASGLEVLALSDGVLKHTLRKPDGNWSTWGNVYGETGSLTGATRVTSAATGTGLEVIVTAGDKLWHTVRFPGGTWQKWGDVYSATGTLGSPTGITATATGAGLEVAAIVGGSIWHTVRKPDGNWSTWGNVSQVLGRLDQPTSAAVVSSGGDLKLITIAAGSLNYTKRAYATGSWLPWAQLTQTPENPPSDQIQRTSTYPAPGGTRPHALSRVDITGIGARTDTFTYDEAGNTVRRVTADGDQTLDWDIEGHLAKSTTAGKSTTFLYDANGNRLLRREPDAVTLYLDGQELKLDRAANKVTGTRYITAGPVTIVKASDGSLNYLINDQQGSAQLAISADNLDYTRGDTTPFGTPRGRKPASWPTERGFVGGTNDATTGLTHLGARDYDAANGRFISVDPVLDPTDPQQINGYTYSNNNPVNLSDPSGLRPEGTCGGFGACQTPTGEKVQEVWTSDHGVWTDTITKTRPPYQPPAQNTSSGIPGLKKPAPQTAQPDDACGSKAVCAMADKVDDAMRLCAEIGCGVYSVTNYPRNNDSSHDVLRAWLLNAWDNPDVVNFGAGDPLLMDLAKTDEVQVLMEMLLTNYKEKGAKAIGEPLRNQYEDNGPLGTAWLGIPADVLGSLTNGAIGADEAKAVIGSFVVHGTIDSVQSARDGYQVVNMHFTVVNNWNWNSATKMLPADWYPTIPTASGVGWTPGKPIDGHFEWGFRSFVGPSGGHHHHHH

SEQ ID NO: 554 - protein, 707 aa, Artificial Sequence
  Optimized for E.coli
MARAAGPATVPEQESIEAQIARAAASGKKQVDIEPGEYRRGSVLDLSGLDGFTINAKGVTVVQTRLVQAVRTGTSNNLTVTGLTINYDPLPFTQGRVIGLGKTSDGKPWMDVRIDAGYPRPDKIPSRVSVYDPALRLWRSQAYNIPVTWQDRTAGVVRSMGGAWAAGTGDIVAFAGEAESGPDIAIGVGGANNTFKDVTLHTAPGFGFQNRAGEGNTHLDNFRVVPGPPPPGGTEKPILTTTWDAMGFGWVKKGPTVENSTVVGAGDDSMSVQGFGTAKVLKADGDTLWAAFADGFRNALPGDRLQQWTDGPTASIRSIAPEKDPAIKALAGAKADFTYKLTLDRPSPWNAGTDITNLDRIGSGFVFRNNRIDSSGRGFLVKARDGVIENNWMRGVNSISVTPENTSDANANSGGNLVIRGNTFTGTLVSAPGGWDSCQVGAVSFDPGSASRPLYPDITIEDNVFQDIRGTGLNLGSAKNVTVRNNFFQRSHQATYPATKNRCGIPKSSVVYVSNSTGVTFEGNTIDRIGPYSVQQVTVDDRKPSGISGLPGGVKVLNPYLPVKAASTYTISNRDSRLLLAPAGGSTDAGAGVEQQSAADGSAQRWRLSPAGNNNTVRIQNAVSGLFLTGGSDSAVTQQPRSDDQSQRWRLLDTGNGTAKISNVATGKVLGATDSAPGAPAGQWPVSGALDQAWKFTDVSPHHHHHH

SEQ ID NO: 555 - protein, 707 aa, Artificial Sequence; identical to SEQ ID NO: 554
  Optimized for E.coli

SEQ ID NO: 556 - protein, 1024 aa, Artificial Sequence
  Optimized for E.coli
MASKNISQLVSSDGNSSAPATSAPGCFVHDGESIEGFPNKWGKIFSDPHKGNQVEFYFTGDQYFSTVAKAILDAKETVFITGWQVNFDVELTSEMTLYQCLETAIDKNPKLQIYVMPWLSPKVGVDTGDFETMLAVFQLNSGLPAPARAFALPAIAQSDQKGGLGIGFSHHQKLVVIDNKKAFVGGIDLAYGRRDNGRFSLSHDGRVGNELYNTCIPAVHQMTKVEQGKYLTRAELLAACFDGKFGKISTFATSAPAEPIAKLQDKLQVISDAGADLTKRISDKWNSSKLLPEFVGKLADMPVDAAQTASRWAFSRLDASVVDKIDGLRTMGTAHATDAETALVAWLNHTSLERLPASLRATTVELIETFTIATLSYLSNMANTRSARYENLRNLRKIVPASGKVISTSQPRMPWHDVHCSIVGPSVSDLSRNFIQRWNGLAVRYERSHGRIVRPHALRQVFASLGLPSIAPVKLPRIAPAALPSTQARPGKAWVQVLRSAPVRLLADEKAGTAHKSDSAPSPTIAENNCLKAMLTAISGAQKFIYIEGQFFQSAHGGKNTEMESIAGPMQTLLDVTKTRGYKKYAEQLGIKGVPPQKMLAKLRWSQIDDVKADIQGGGADFINDLNAIIANHASIEATRALGPADKAIANPIGEALALRIEGAIQDGLPFHVYLIVPVHPEGTLNTLNIMTQLHLTMQSLVFGRFSLVNRIRRALLVRDLRMSKKMTLTDAKKVVAGYSLLRLEQEVQDEWSDHLTLLNLRSWQMLGGRPVTEQIYVHSKLLVADDRVAILGSANINDRSLLGDRDSELAVVIRDDAQIDVKLNGIDSEPVSASVHKLRTGLWRKLFGMTDGATPATELSTVIGTPAAEGAWLAIQKTARVNAEAYSKAFPFLANVKGEPSSIWPVWNRDQLCLKFQMPFDERFWRKAEVRDPSFSWNAEQRAPESAPVGVKGFIVALPVTWTAGEDNISGMNLTLLAEHNQEPATLDQSEPSGNGLRYAKGNSLDQANEGESTSAVHHHHHH

SEQ ID NO: 557 - protein, 704 aa, Artificial Sequence
  Optimized for E.coli
METATAGQDSGALSARVAPTQEDIQLGSWMSQLGSTIGDRPLNQIVMPGSHDAGSAGITKNSGMCDAGDTVDTARKWPELASSMSRTQSGSLVEQLEAGSRYLDLRLCKQGDKWYSYHGGPLGRQFFDSLGGNQGIVPGEARELADWINRHPKEIVILRVKTTGPAATLKEDSRAAIARLGGLVGGGGLDNPAIADGSLKPTSTYNEFMAAGKHVVVVDDTDSTTYPWAWQQPNVQDYRGSYVGVSSKWDDILKAALDPALEQKTYDAVLRRGDEVLGKTPEPGSEKKLFVQQAMIDPSNSIPSAAVIQILEKLKLVSEWKADNFLISMENELNRQLLAKLRTSWNNTNVTDNMNIVMTDDVNQNRNGVAAGELQREIISKNLPQRITSHTFYNSTRKADGTWTGPSALSGAGTAFRYVGDRQAVGATRDGGVQVLGVGADGNIWHNLRRPDGSWQGWNALLAADNKNVGFAAKDIALTTMPNGDAQVVAVGKDGYAYHNIRSADGGWQGWASMPGHDAGLLKATKVAAAGMPDGSTQVLVFGGDGRMRLGTRAADGAWSSWKTVAGVNAPDFAGSALSIAALPNGDSQIAAIGNDGNVWHTTHRADGSWSDWGLPAGVSGGAMEASAVSLAGMPGGSVQVAAVGRDGNVYHGVRSSGGDWTPFQRVSGIKGAGAFAGDQVGIAGLPNGSSQLILTTRHHHHHH

SEQ ID NO: 558 - protein, 1579 aa, Artificial Sequence
  Optimized for E.coli
MGPRHKALLIGASEYDDETIRSLPFVRDDLQRLEGVLSDRGFRPVEIAESQRGITPNAVNRHVLRFLREAGRGDTLFIMLSGHGVHFDGRDYLVPEDAYYESEPFAESCVEIGWQKELEDSPAGQVVFLIDACREGSARRTKSPTRMPGWERPKIAATLRRKIAYVYACSKAQYALYVDESEAVLPQHADAAGTQPKDSFSLFSRAVSDVVSAVPHTLHMGEFLDEVQRRLTALHTAYGKTQPVQRVRAETDIPWQEFTVLPGPARDAAEHPWVRSTATHPAWERTTPGAAREALKDVCATLAARLAEGYETAAATLRDDPWHDAELAKRAQDRLGFLTGRLAAGAELSPTEGALTVLLPLLGQAFWTHEAAQRAPVVTAGPADQPTPERDRFGKFAQGFPRLQRRLRTLEQRGVSDGSAERIRWWLFHRWLIRQPELYASQTLKTLLGPPPGGTQCPEWVTEALSGERFMRFLQELRAAPFAVPRDTPGRPGDQRDGDCDVIAASTRDEHEVRESLVASLAKAAQAFAVDPVDLPEILVEHIGISDSVDLDELLTTIRGSDWRTSGLGRSLNAVCGHPAVQIALREHARRVDGLLRDINRTSALAPLRSLPPYADADRVRLGGNTPTHLADGIRFQLAEDRVQELLMGEELYGERELAIRELYQNALDAVRYRDRRTEYLRRTGEMPTQWDGLIEFVQKADAQGRPYLECRDNGVGMGLDELRNVFSQGGARFVDLPEYIEEQTAWAELGEPRIELHPNSRFGIGVLSYFMLADEIEVTTCRMARDGRPGNKYQVKIAGPGNLFRVDDLGPGTDSGTTVRLLLTDHKERVSCVDTLQRVLWLAPYRTSAEHGSRRHEWEPGQLSLSGPELVWADDSEMFRRTGACYPSGNPDVWWVDGTGRFLSDGLLASTNSATTGSSARERYGAVVNLREQHQPELSVDRKTIRSNDEDHVNAVLSEALPSLFSTARPLLVPDWLVEASRSSVGFGDEVAERARTSRVPWPAGDTERPFDALGFFRPDQTLLPLVTGHYPAVREEHGPSYLRLVPTPVLRWRLLTLYRAGLGDPLTEAAQASPPLPCARPSDHQLLSAQGSYTTLNWTQRYKDWLTGPENSTFYLLKSPSRTLVDSGILSAHSVEVWRDPEQVVTLDEIFGLVGLTELTAEAVAERLTALGYSVVPPTGCERVRREDLPLLRPLGSVTDGWLEPGSDLSVAQLCLSAARAECSTREAADRLRDLGFAVPTEYPNSDAWTAEDREVLRGLWDLHADPVPPDRAREISYAQLISVARASGATTQAVVALLRDTGFSVPSPGTPGLMFRDEEWALLVYNGISLNVDRPVPLPHVVGVAYRTGQTPEAVAVRLRALGFEVPELPADGPLPSKQDINFLYARYESSSGKAWPRPDRPMGLGAIAERAGRSTLSMTETAARLNGLGYRCAPAQWLLDRFQEHDVEALRWTLPDDDHQTVISPPQLYAVAEHLGRPAEDVAQSLTDFGYDVAEIPGTRIQERKAEADLIDVLSSGEDPVIDIAYEAELSLPTLATVAMRLGLPFRTVALKATALGMRHEAETWFAAGHHHHHH

SEQ ID NO: 559 - protein, 1286 aa, Artificial Sequence
  Optimized for E.coli
MAPSPTSGASSSTPSSGPPSAPPSAPPQAPPSEAKRAAERAAEPAGPEQTPAAAAAAAAPAVSDAVYAYDAAGRLVGSTDPAGETARYRYDEAGNRLGIDRFASADLSVLSLVPTRAAVGATVTLSGTGFSTTPSSNAVSFGGQTAEVVSASATRLKVKVPAAAVAGKVSVTTGGGTAQSPESFTLAAPAPSVTKVDPTSGYAGTAVVLSGAGFAAATADNVVRFGGGVVAEIVERTDTALKVLVPAGAATGPVEVATPDGRTTSAAAFRLVAGDGGGEIETSVETSVTDETPPTVSVTTPGNQAQVVFDANAGDDISIGFTESTFNQTVTVRLLDPQGKRLESAAYTGTAGDWEMTDVPVSGQYSVIVDPGTGNIGSVKVTVSNPRISALDLAGPAVDAQFTRPGQDHLLTFAALLGDSLSLGIDATGLAKSTYARLYGPDGAEIDKVYVTGTRIGGLDVDALTQSGTYTLQLDPDAAALGTVKVTGSHYADAGTLTATGPALDVSLIRQGQQGRAQFSAQAGQRVSLGGSATGFGNFTRVEIHQPDGALLDYFLVPDADAGQWDSATLTTSGTYTVVVKPGSPLATGKMTLTLSRPLALAALTTTASASAVNITRPGQNAESSFQAQAGADLSLGFTANTFPQYIDVTVTAPSGAKVVDGVNVTAGAATTIPLPVLTEAGTYQVVLDPNKGAVGATSLTLSAVARATLTADGAQQPTTVARAGQRVRATFTAPDTAALGLAVTANTIAESTEIRLIGPDGGAGALAGRVASKASDTFYLTGLTSGTAYQLVFEPAKATTGAMTLWLSKPVKAGTLSTTAPTLTGEITRPGAQLEFGVNAVTGYGAAVVFSGTTLTETSALIHQTPGGVEDNVGSLSKATLDADLRAPLAVGGHRVFVRPNGSATGKTTATLVPNVTGGALATTGTKKSVAIATAGQNAHYTFTGTAGQKLTLGLDTPPGAWSLSVHGPDGKWLVDGRNMSATTVSYALPALPANGTYTLSVDPNSLKTGTWNLGLTAAATLRAATAADTADGPDTAEGADKAAGADEPATPKPPAAGVTPTGADAWQPDKGNLSGHDWLTRRGDAPKAPPTLRAPPKTTALTGHVLKLDGKPLAGVTVSAGANTARTDAEGRFLLAGISPEATTLVVDGASANTKQRQYGRFDIRIRPKADTSVDLGFPVWMTPLDMKNTVRFAAPAKTDVVLKTPKIPGLEVRIPKGSVVRDEKGRPVTELGITAIPIDRPPFPLPENGVVPVFFTVQPGGTYVFPEGADRLPELHAHHHHHH

SEQ ID NO: 560 - protein, 943 aa, Artificial Sequence
  Optimized for E.coli
MAADDVMAMSYHVQGDRIFLSGGVTYADVVSLPALLAKAQAEGRPIREVVLRTSNGGALIAGEWLQGVIRTSGLNTIVSGHCISSCSIMQSGGVERYLAGDLPIVDSVQIHAASNSGKVIYTPSPRMTQIYTGNYGGGIDAGLLHKAMYEVVQPNGLLVFRDPARTTGASVTFDPDGSGSKLESFPGQDIYSNRVITAKGYRDPGDTLNVTANVSGDINPGYLRTGRQLQTFVDDDFARWNTNWQSSYINLAQSIYNASSNGPQGIGANSVQDYQNDPTYKALLLSKLRLGDLDVSTLDNSMGVIRVTNGATWRTSATTGADFMLVDNGTIALEGGALRASEVRVMAAGMLVGNGDVAGTAMDLSALASGTRPSWREDGFNRLRVYGTLMPRGGDLVTHGYVNIMPGGKVLFDVTENGGAGSGRLRVGSFFDSKQTDGALVISKGAFLELNVAQGYYGQDFRRDLVQGPIYQGGFEEVVRLGDTGYSASITGGEVFRPRHNSLLSFNVKQAADGLWLTANPGFDQLGLFTNRTSGDGLGRALATASDRRDGGLKSLLGALQFADRDVIAQQAGALRGDAHATLRLADNALVGSIGNVVQQHQAAMRSGGDADGLASQAAQSVSAQPGMRHGSLFNQLAMHLVEPAAGGGEGSGPGRNHGLWARGFASHGRIDADGGVAGLSHNIGGIVVGADTRVADDRVTLGVSVAAADMSTKGRDGSDFSGDVRALDVGGYLDATYSRGYLSAAVRYTDLRHDTRRSVSGIDGLQQPLRAKYSNDAISARVEHAFSFTTGKGLVIQPLLPVVDYARTSATRFNEGQGAGALVGRSGSLESIRVGAGLQLFRTFEGNNGERITPRARVVWQKELGDSQARYSTGFAAAPDLVFGASSQAVGEQVLAWNLGVTSRASERLSIMADYVGERRDGQIQNGVMLGLGYKFHHHHHH

SEQ ID NO: 561 - protein, 661 aa, Artificial Sequence
  Optimized for E.coli
MGSPSDAAEEAGHLVGRGIADVTGEAAETGMMGYSSFDQKTSGIHQRQRSRAFVVVDRSSGKRVVYVNADLGMIFQSVRQGVMARLKERYGSLYGEENVLLSATHTHSGPGGYSHNVAYNLSVLGFQKETYRAIVDGITESVAKAHDDLKPGTMSLGTGTLTNASVNRSREAFDRNPAADRSAFPDGIDPAMTVLRFRQGGKDAGAISWFATHNTSITNKNTLISPDNKGYASYVWEHDHEGVRYLDDTPGFVAAFPNTNAGDMSPNLNLKPGSGPTEDEFENARVIGERQLDKAREVYDDARPVTGGVDSRIAYVDMENVTVRPEYTPDGKEHRTCPAVVGASTLAGSVEDGPAIPLFEEGMRTPVATVLEALRVDTPSWLATCQYPKASLIPTGLLSNVHPVTPKRLPLQIMKIGELHLVAAPGEFTITSGLRVRRTVAERLGVPLDRVLLQGYANAYSQYVTTPEEYDTQNYEGGSTLYGRYTLPAYQQEYARIADSLRAGTALERGTMPADESGRQFTFQTGVVYDNPPSGKAFGAVLKAPESSYARGSTATAEFATGHPKNNVRRGSTFLEVQRLENGTWQRVLDDGDGETVYRWTRINGLTGTSKATITWRIAADTAPGTYRIVHHGDAKNLLGRITPFSGATGAFTVKHHHHHH

SEQ ID NO: 562 - protein, 693 aa, Artificial Sequence
  Optimized for E.coli
MGLEPAALNGAVTAAADGVDGSGTQAGLVGYDGAPGETGTAEGATQVPAPKRDQKAAPLKAIPKDEPERGLVYAGLSLPGSDRCGGTLEVTGSTQCSHGPDVPPKGVDIRQDVPPVAAPVARTPALTPAAGAQAPAAADLLKGSAPVLDATQKALLGGAGTAADAARAGADAPAGSKLVCEGDGSSGNRVQVVYVHSPGNDRFAQYLASFKKWAADVDVIYNASAAETGGERHVRFVTESDCSASVLNVQISDAEIQDFNASNRALAAQGFNRKDRKYMMFTDAKVYCGIGTFAGDERPGQDNLSNFGPSYGRTDSGCWSGSTAAHELGHNLGAVNNSVPNSSKAGHCVDEWDVMCYSDAPDYPQMRTVCPDRAHDDRLDCNHDDYYNTSPSPGSYLTTHWNVANNRFLVAGGGSGPDPTPTPTPTGTPTRTPSPSPTPTGSTTPTPTGSPSPTATPTATPTATPTPTATPTAGNTGPAVAVSQVTQNSAVLSWTAAPAAAGYDVLLNGQAIGTVRSTVVGVVRLAPGTSYTVAVAVRDAAGAVGKPGRTATFRTVTDTGRPQPGTRYTMVNGLTGQAADLWGSSMNDGTVAIAYQRTGYANQKWQFEDAGNGAVRIKSARSGKCLQLGGAPVAGQYVAQQPCSDTAAQKWQLNAVEGGFTVTADGGSLVLGLSTRWYYGGWLLELQHHHHHH

SEQ ID NO: 563 - protein, 766 aa, Artificial Sequence
  Optimized for E.coli
MGKNNDVPFYNGQNDSFLTSLNLQLPGKYYRPGSGYAAKESLYRADVHFPAVYNGSFNWDNPRENLVQAEDTSEPYIRIANEGYLNSKVPAGDRMVTEVERVNNSVISSKYWGNPEFVLENMDKHMIQTYESFRELGQFYWIRDIAYLSGGYAGASGVGNINKYSLWYVRTSKPQVKDFQAMSGKKDIPVKFTFKGFEYVSKNKGYNDRDPNGTTVNPYQKAAGERNRVKWMLDITKDGETVYHQENYLRSTPQKDNQKPNEGDAGQFKKEDITWQPQLCGQYTAKIKVLDAVQRESNEKAVDFTIDGNCGTEVTPNPDPGDEDDFKYKIDFSADRIEGETAREGKNIKTRVDVSRDNFKLERDQYRAKVNNNINKSQQEINSTESDRDSAQSSLSYCRRNPIHEVDAEGKDHYYDRDCSWEENKLDSAASKLDNARQKLEKEKNKIKKLDVLEEKYMNPETVVVLKHNGQQVALQKVRLTEGEKKTLNLDWQHKGKGTIQAEINPAGNRIDIEETTYKNNPIKTAIYEPSKEKAMCGVTSVKGVVETVSERVSKEDITGAMYYETLTGSIGNLAPSKLHSGYGFSYEVNGKYKNDWNANYPGVFTAAKAQYPFADEGLKSTQDLEKKELKDTTAKFLPKNMYLSEATGHVFDSKRPTKSLYWDGQEKIIDGGQKWYSPLKTKNGVYTFNVETAPAGINEMSLCLTEQVEIKGVAYDDFIKRRVFPDDPFPGGSGVGWNWVGKEDVLYKLTDWYYMRNRKHHHHHH

SEQ ID NO: 564 - protein, 950 aa, Artificial Sequence
  Optimized for E.coli
MEDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQTIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKPQFFNTFTLQGTYTGTAAKGEYEDWKTITQNVNDTLKRLSAKEWTGYKTVTAYFVNYRVNTSGQFEYDVVFHGINTEEGAENKAPVAVINGPYSGNVNEAISFTSDGSKDEDGKITSYKWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVKHHHHHH

SEQ ID NO: 565 - protein, 187 aa, Artificial Sequence
  Optimized for E.coli
MGHGYIKEPVSRAYMGALEKQTLGWTAAAQKYGSVIDNPQSVEGPKGFPAAGPPDGRIASANGGSGQIDFGLDKQTADYWVKQNIRGGFNTFTWYYTAPHATSKWHYYITKKNWNPNKPLSRDEFELIGTVNHDGSKADTNLTHKIFVPTDRSGYHVILGVWDVADTSNAFYNVIDVNLTQHHHHHH

SEQ ID NO: 566 - protein, 335 aa, Artificial Sequence
  Optimized for E.coli
MDYDPKKKGWYVYGHGQVSADGKQVVPDAKTRVWAFHGAMFNTGDILPWDMGWLQDVIDWLSGDPVELTTGMLTDSRTDLAVGGTLGSAEITRTYWQGDPEKRAFGIGRDLSYNAFLHSKKQWQEVDLYLPGGSKTHFTRTSTGTDWTNAVFEPLDSPSGFRGSKLVWKGYDGGWDLTFRDGSVWVFPQYAPLKEIRDRHGNAVKITRLDGKRGDITRISAPGGRWISLAYDAQHRVTGTKDNAGRTTAYTYDTAGRLDTVTDPAGKVSRYTYDGTTNRIRTAVDACGITYMSNTFDAAGGSRNRRSPRVRSTPSSTPRPARARSPRRPHHHHHH

SEQ ID NO: 567 - protein, 122 aa, Artificial Sequence
  Optimized for E.coli
MGSQHAPDGTEGQTLPFWVDVVEEEGDEGNAMGGLFRHDGETVLRSVPLGPLRKNLADTVDALQKVFEEVADRGGALPLAEAQLSFQVTATGGIQLIGSGQVQGTRGLTLTFKRPSHHHHHH

SEQ ID NO: 568 - protein, 150 aa, Artificial Sequence
  Optimized for E.coli
MANLSRAGSLKGVNLFNGSWTVAIQAANLQYVSAEPSGNVVANRNAVNEWEKFELIPTGELYTFALKAKSNGKYVSFEPNGRVVADRTSIGAWEKFILYNGGDNRIYVLQALSNGRFISANGGRELTANSYVAGSWERFVIVYFHHHHHH

SEQ ID NO: 569 - protein, 83 aa, Artificial Sequence
  Optimized for E.coli
MGVTTLTGNQSDNPTTVALSDTGTTQTDLAAGKPTSESSNTVTLTFPAATEHYFHALITADSGRPAGQVSEFHIWSSHHHHHH

SEQ ID NO: 570 - protein, 972 aa, Artificial Sequence
  Optimized for E.coli
MAIPTQEPGVTLRVFDVQTPLSKLCTLKPGQTPNHDALKSTVDWSTTDDFGGFSDRFVSEVTGYLVVPSDGTYGLRLTSDDGSRLSIDGDTVIDHDGLHGAEPKDTSVQLTAGSHPLRIDHFERDGGQELRLAWKPPGASDFTTVPREALSTDAGVVRVTAPGRKECEASGDTPGDGLPLTDVRPDLKLTDLRPDGFEPQVTGMDWLPDGRLAISTWGGSDNVAGEVYLLDNVTGDTSKDKVTVKKVASGLREPMGIKYVDGSLYVSQKHELTRLVDKNRDDVADEYRTVATWPYGKNFHEFAFGLLYRDGYFYVNLSVSINLGGATTVPQPAPGRGTTYKVSRKTGKISPIAGGLRTPNGIGWGPKGEIFATDNQGGWLPSSKLVHVKQGRFFNHYTEPSGAFDAATPTAPVLWLPQNEIANSPSTPLYVKKGQFKGQMLIGDVTYGGLQRAYLEKVKGQYQGAVFRYTQGLEAGVNRLSYGPDGSIYAGGLGADGNWGQEGKLKFGLQKLTPNGGNTFDVKTMRAVPGGFDLTYTQPVSAKTAEELAKHYKAEQWRYTPTSDYGGPKIAEEVLPVRSAELSKDKRTVKLRLDDLKPGRVVHLRSPRPFTSESGESLWNTEAWYTLNAMPGKQPPAATLYEAEEARLTGTAGIATDHPGYSGSGFVARYNTEGKVATTFDVQVKKSGTYDVNLRYSNGPNPFQGTKSLSLYANGKKLRQVKLASTSDWNSWSTQTEQVELRKGDNTISYRFEAGDTGHVNLDLITVRPKGASLALFDGTAASQSQWQHTDGRRLEWPLADEGSMEVCCGDIRTIDAYQDFKLHAEFRVPLLPDDVTGQNRGNSGIFIQDRYELQILDSYGDTTLDTNEAGAIYLKKAPDVNAAKAPETWQTYDIVFRAARYDDSGKKTADARLTVVWNGQKVHDDITLDSPTASGRAETPSTGAIRLQDHGNKVRFRNITLEPLTHHHHHH

SEQ ID NO: 571 - protein, 972 aa, Artificial Sequence; identical to SEQ ID NO: 570
  Optimized for E.coli

SEQ ID NO: 572 - protein, 1204 aa, Artificial Sequence
  Optimized for E.coli
MGHPDEPAAEESFQQVTLAKGADAVGEPMSLAVLPDRRVLHTSRDGTLRITDAGGDTTVSGTLDVYNHDEEGLQGVGVDPDFAENRAIYLFYAPKLDTPAGDAPENGTAADFAPFDGYNRLSRFTLNEDGTLDKASEKKVLDVTTSRGTCCHVGGDIAFDADGNLYLSTGDDTNPFASDGYTPIDERADRNPAFDAQRSSGNTNDLRGKVLRIKVAEDGSYTIPEGNLFAPGTEKTRPEIYAMGFRNPFRISVDKKTGIVYVGDYGPDAGAASPTRGPAGQVEFARVTEAGNFGWPYCTGDNDPFIDYDFATKASGAAFDCAAPKNTSPHNTGLTDLPPAQAAWIPYDGGSLPEFGSGSESPMGGPVYRYDADLDSPVKFPEEYDGDFFAGEFGRQWIKRIEQGEDGTVSKINPFPWSGTQPMDMEFGPDGALYVLDYGLSWFGGDEHSALYRIENSTGGKSPIAEATATKTSGKSPLKVTFSSAGTEDPDGDALTYAWDFGDGGTSTETSPSYTYKKNGTYTARLTVTDPTERTATASVRIVVGNTAPKVTLELPNDGHLFNFGDTVPFKVKVTDPEDGVIDCSKVVVRYILGHDSHGHPITSANGCEGTITAPADTEHDPNANIFGVIDAEYTDGGGGGQAALTTHDQSQLQPRHRQAEHFNNSSGIKVYDKAPANGGKTVGDIDNGDWISFSPYNLTGSKTLTARISSGGAGGFLEVRSGSANGNLLGSAPIPVTGGWETFQDIDVPLRAVPKQTTELFLVFKGGAGGGALYDLDDFQLSTAVPGKTEKRVLVFSKTGGFRHDSIPAGIAALKELGKTTGITVDATEAAGQFTTNNLARYDAVVFLSTTGDVLNADQQKAFENYVATGGGYLGVHAAADTEYDWSFYGGLVGAYFDSHPQIQPATVRVEDHDNPSTAHLGDEWQRTDEWYNYRTNPRDQARVLATLDETTYQGGNMKGDHPIAWCQTYEGGRAFYTGGGHTKESYADDAFRQHLLGGLRYAAGQVKADCTPKTGYRDLFNGKTLEGWKQAGPGKFNVVDGELRSEGGMGLLWYQAKQLESYSLKLDWKMDGDDNSGVFVGFPASDDPWSAVDKGYEIQIDATDAADRTTGSVYGFKSANIKARDQVLRPPGQWNNYEIKVQGERLQIFLNGVKINDFTNKDPERSLKDGYIGLQNHGADDQVSFRDVQLKELPSAHHHHHH

SEQ ID NO: 573 - protein, 169 aa, Artificial Sequence
  Optimized for E.coli
MAIDVYLQIDGIKGESTDTAHKDWIECRSVQWEVLQPKSATASTGGGHTAERTEHKDIVVSKLADLATPLLLQNCSSGKTIPKAKFEFLRADGQGERIKYFEIELENVLISNVAPSVNAGDILSESLALKYSKVKWKYTQQKVGGGSGGNTSGGWDLSANKTAHHHHHH

SEQ ID NO: 574 - protein, 428 aa, Artificial Sequence
  Optimized for E.coli
MDTGSFSLLYDPGPAHDCYALVVEDPPDKNTTPDPGRTSSAGCDAFAGTEEFTRKSPERPTWDIGTYGWNTSNWGTSPGYSFTTQTAAKTVTMRNDASGVCGLHETNVSYTYPDSQLKPGPDRAYRTAADGRINVSYRAKIQQTEPFTCGEKRALLTTDLIFEDSEHGSAHPDVISVIHYDPGTFKAPDSNGVVWYTRDDTTMTCPDGCRVMVRSPDLMKDATWASIDDDFSQLFDKYVDYVNPEHLPKSDFVLRGIQIVSSNTGSSTTASVSDVDARMTPNAPVHAPLTYGLKGSDGQSLCLDDYNNATTPPAVADIWDCNGGDAQDWTIGQDDTLQVHGLCLGVSGDGTADHAPVGLDRCDGGAHQKWVLGRYGQIYNPVSGRCLEVANASDTRGDKNLELFDCWGGAQQKWWTPAGDYRHHHHHH

SEQ ID NO: 575 - protein, 330 aa, Artificial Sequence
  Optimized for E.coli
MDTWSNGHIVKGAIEAEWLRLGPDNVGWAVTDELDANYLGKFQVFERPAPHMGNSIYWHNDTGAHQVGGLIRDKYRDLGWESGDLHFPTTSETQTPIKPGAFNHFQGGSIYYSSSTGAWPTWGAIRDTWANAGWENSGYGFPKSYEYNCNDGINPNDKSWNYGGKGQDYQGGRIFWNSAPNNFNLPYSSVHGSPRTLKYSSTTKYTSAQSNAISQWNALGRVNIEPATVLNNEVLVVRDINRSDYTWAGLYTYRGADFSTLEMNDAKFTGPSDSRIPRVMTHEWGHSLGLAHSCVGSNMDELIYFNNNPNLSDLDKSSYNTKHPHHHHHH

SEQ ID NO: 576 - protein, 799 aa, Artificial Sequence
  Optimized for E.coli
MAGQPAPATYTVAVGRTGSYAYPDDTQASPYTDKDGTFYFQQSHALYGAKDSRQWDFFTGRDFDSATRSSAISDAVNPADPSDRNDDTTARCNNSPTGRQSSYAPQGSHYAQRNYCDLAGVWVDPDSGAWYGLVHNEFTPQPFGDGLHYDAIDYAVSTDQGRTWTIRDHVITSPYSTARGDTAAFPQQTFSYGDGDQRLFADTASGYFYVFYGSRIVDKGGSWGAFQQHVARAPMSAKMAPGSWQKWYDGAWSQPGAGGLESDMVPADGANPTGYLPPAKEYNPANPGTVSRQIAAGTLAPSTPLFVMNISYDAYLGLYIGTPQAVDQSGNAPQQIYATKDLATQKWTLLGDTGGYHTASWYRWFLDSASLTGSTIVGKTFRSYCSFACAGSDGQYVELTVGSSAPAAPPVDLTRTYRIQNGNGRVLAQTAGGSAVTSTAKAAGSARESWRFLAEGDGSYRIVNAATGQLLGVDATSTAGRAWGAALTATGAVGGDATVGQQWFILPSKAGKGRFQLVNRYSGLVIGMSGTSGRLAETAPARSWSDTTGGTVGGGRTAAEQALALAPTGTAPEAVVLTAPGDRSGTVGKAASVQLGATDSAGKPLTFTATGLPAGLSVSPSGLITGTPTGPGVSKVTVTASSGTASGSADFTWTVEPDLGGNHTLTTGGKALDDADHSTAAGNPLITWTASGGSNQVWQFRPQPDGSYELVNGLSSMCADVSGGSTDAGAQVIQWPCSGGANQHWNVRLTADGSYSVTSAHSGLLLTTASGADGARVTQEPDTGSPLQRWSISHHHHHH

SEQ ID NO: 577 - protein, 799 aa, Artificial Sequence; identical to SEQ ID NO: 576
  Optimized for E.coli

SEQ ID NO: 578 - protein, 812 aa, Artificial Sequence
  Optimized for E.coli
MVHFKNCPDPSLNANSQSHPEFSSELEHIKARMQNFIKHSVTDQNIEVTDARVTAEGEITSLLKERLDKEYFKLLSKITREVNVEDFGAVPDGRDNTEAFRKAIGNGRVKVNVPAGEYLVQGIKLPSWTTIVGQGKGITVIKLHEDTPAHEWVITNDDYQNGNRNIFVQGMSLDWNPSRQCGVRNPGGQFSSCLTFAKVEYGWIKDVEAINAGLHGIDITSPTYDHLPDTDWTKDGSRYIWIDNCVTYGSGDDGITTHYSEYIFISNCHSGNPRGTEFVEGVSNSNGIEVDDGSRHVWLLNNFTSGNIRGVEVKAHELWPASQNVHIIGHVSYRDVRAFDLRHIGHHQITDPESTTAYDVTLIDCSAIEPVFNSLYDAVTPRALVISAYKNVNVSGFTAIGDPDYDYKGNPVVALQYRSQNITINGIKIRGFKKAGVDINLSGGSNKTDYIKISNFDIYKSAPKGISIGGGLYNVNILNGTMITDNGTVGIQSPNNQATILGVQSEGYSVAASIKGQTYQQIPINLKGGIQLATTSGFAVNQTSAVIAGTGDITARGERNAVISSSGGSSTEGSRALIASSNNAHIKGNHVSRTILSSENIILEEPYTVAGGHQSMKWLLDSVRGNGTFAGAISSSLGGYGEYFESSTGQLIHTGTIVTLRGEKIAPADVGDYMLGVISETSAFISGASSFVWQGRYLTNEFGGFIYEVVTDEESGELIRVPKQNPDYDTALEANYHSRAARDEWHVVGLVGKHYVRIDETVSQGNYLTAHNGIGTKAAEGSWKVMKITSAYTSEKGYGIALTVIKHHHHHH

SEQ ID NO: 579 - protein, 603 aa, Artificial Sequence
  Optimized for E.coli
MGQDISGSQGSTTNEFNPWSPQNGHPYRHGAVPGMSQHENYKKWLAAHNQAAATGQQTLSYGGGVDGIGVQSGHSKVYLVFYGNQWGTQTTDAGGNAKFSNDSAGAAGATQQMFKGIGTNGETWSADLTQWCDGPNVATGAVSCPSNANFIPYQSGGVLSGVWYDNAAASPSQASGNQLAQEAVKAAGHFGNTTAAANRDAYYIVLSPHGTNPDDYQNPTTGYCAWHDWNGDTTLTGGAASSPYGDIAFSNQPYNIDAGSNCGVGFVNSPGTLDGWTMTLGHEWHEMMSDQNPAGGWTNHVSGSSYNGQENSDECAWIQPGSTGGAANISFGAFGSYAEQASWSNDTNSCAISHAILTHGNAVTVTSPGNQSGTVGTAVSLQINATDSATGQTLGYSATGLPAGLSINASTGLISGTPTAAGTSSVTVTATDTTGAAGSTTFTWTESTGGGGGNAITNGGLETGSLTGWTTVGSTSATAPAAHSGGYGAMVGSTGPTGDSSIAQTFTAPTGTSKLSFWYSNTCDDTVTYDWATATLKDNTTGTTTTVLAKTCTTTGTWTNKTATVTPGHSYTLTLSNHDDNYPGDPTYTYYDDVTVSHHHHHH

SEQ ID NO: 580 - protein, 395 aa, Artificial Sequence
  Optimized for E.coli
MGKSAATTQVEPGGACTAADLGTRHPYIKTTEVTPTITHFKGWYVTEGTTGSQTITTSTQTTISVSVGLNGTVQGSFAVETLGTVGASLGLNVQVTYSSTSSESNSVTWNFNRPGYYGVYKGTKKVTGTYGSLNCNRVQQGDASWALKWTEGAGSGSFTTYTALEEGAVRCEDEVPANSIMATAQGLLDCGSAAAKAEHPAGAVAPAAKQLRDRLVQRPALTVGTSAEQPKATGRSARSALNCGTDAYKIAVPGKPLSWGAPLLADDGVRLRPSTIFSAHLDNWRLCDVTENNGVLEASLWNWGNGRCAAIAEQNAATEGAVLMTAPCTEDDLQRFYIYRDVPGSSMIGVQNKYTGSMMGHDRYADGEFIRQYSSGRQDGTGTYTLTGVHHHHHH

SEQ ID NO: 581 - protein, 1413 aa, Artificial Sequence
  Optimized for E.coli
MDSSGPVPGNPTQSALLQAQATDKPVPVDSLTSQTTTTTANPDGSLTTTEYVQPVRVMKDDAWTAVDASLVKNADGSLSPAATPNDATLSGGGSGPLVSLTDPAGRGLSLSVPFTLPAPTVSGNTATYASVLPGVDLEATISDQGGFSDVLIVHDATAAANPDLRRLTLAATTQGLTLAGSADGGMTASAADGTTAYTASAPIMWDSTTTTAGPQPASMHLDDATSTTPPPPDGPAPGADVAPVTMTTTSNSLTLTPDNSMLTGTGTTWPVYIDPGVLPSETTNHYFEAQHGCNSSSASSHEYDYPQRFGEGVGYQRYASSNGDCIGAERAFYQLDTSNLNSSMDIIKSELHLTETYAEAYGCTHTAPLTLKWTGGISSGMYWDTQPSVVSTIATKNPSSAYNGAYASQPTSCGDQDVVFTVTDKIAKIASDNDSTWTVGLYGDEDSSSSNIDFMRYSTNPYIQTTYDIPPDTPTSETTTPDAHNPSGANCGSSTRGWIGQTTLNGNTSDITLNAKLTSNVKGENVKADYTVWDDQTANSSGNAATVATPSSSYVASGTTVHISIGTTVEDGHQYGWQVRAYDGTLYSSWNSPCGFKVDLTPPSQPSVTAPSAVFPPAGSNQAPTGYAGQTSTITVTSSDPTPTGCTRGTCLSSDVWRFCYALDVQPAVNCPDYVTATTNSSGTPSASIPLDPTTWGTHTLYVEAQDHAGNTQALPTTYTFYAPWNPATKVAAGDLSGDGVPDLLGTTKNGDLTLLPGNTDPGNSPTLASTASQSPDGKTSWNDYLITHRGSIKQDGLDDLFAKNSHNLYVYKNDGAISSGTPGHFTNTADVYGPLDKPQCLPTADNATNCVTYNAADWSSVTQMIAPGDVYGTGYPDLITIENKQLWLYKGSAQDSSYFGPATGGTTSTTPVLLGTGDWSHFTLIAPGTVNSTPALWARDNNTGTLYTFPLTADSNGLPPLLTAPTSSALTSGLTAADGTSLCADDSHAATQNGNKIQIWGCNNTHAQSWTPAADGSIRVLGKCLDVTHGGTTDGTLIDLWTCNGTGAQQWKLGSNHSLLNPGSGKCLDDPNSSTTNGTQLQLHTCNGTGAQSWTSSTPSNWASDAATALPVTLAASDYPTVASPGNLNGTTAGYPALYATTSAGELIEYPGAAPDTNGTATFGSPVTVGYYNTANAAWPLNDDTDRTAADSIGTNDATLNGAAAWTSDSTRGTVLSLDGTTGYAQSTSSALPTGTHTDPTDGTTTDNNSFSVSAWVKLNSLTNNSTFVSQSDSTGNANAYQLYYSSGSQKWAFDRHDDDTTGTNFTAVYGAKATTGTWTHLVGVYDGPTNTLNLYVNGTLTATKTFAGTPWNATGPVQIGRRLYQGTYGEYANADISDIQLYNTALPPSEISALDYDQTPYTQLSHHHHHH

SEQ ID NO: 582 - protein, 2018 aa, Artificial Sequence
  Optimized for E.coli
MAENPWVPPQQLAGERNIITWNMQGSTAVETGSTYERLNQLYSRAVADAARGAGLVEQKRVVMALQEAGVPPTSWAPLQAAELPNLVVPDGVRGYKRRVGRDYTYLFHAQTIGDDPAGRVNSAIMTNELPRRLVYIPAVAGTLRPLIGVGYGEDRANGEYYFSFHASSGNGGRDIVPMLRRLVAEMGRLEADEHEGHAVNWYVGGDFNLDPTTLRDRLDGPEVNGQDVHIARPERYTHRSPDGTTSMLDYVVTNDPSMSDVLGRVTDQTGYADHDTVYYGRRIGGGAPCARPRVAGLEAAAPEASADPCPLPRPGAIVSMGDSYISGEGGRWAGNALTKQEGDVWGTDRRSKCPDGSQDCVYGATSYDNKGNRCDRSDVAPIKGAEFEDIPVERRLNIACSGATTKDILTESRNNEKPQIQQLADLARTYDIRMVVVSIGGNDLDFSGIVSDCAKAYYRWVEICSAPNKAARVARSVDAVQAEIVKTLAAIRSTMTAAGQSGYQLVLQSYPNPIPAADNFRYPFDGTSDPRFRQGGCPFTDPDADWAHSTLVPKISDMLRRAAGTAGAKFLDVQDAFAGHELCAKGAEQATEANSNASPLPASKAEWVRWVPYIPNLGWLTPNAQGDVQEAIHPNAFGQQALSQCLTGFGKEAPASDRYIFTCTGSGDGMKVVPDGSAVREGIVRLRNAETGEVLDAQGNGTDDYLVTRPDKAEASQRWLLRNVGEKVTLQAQHNGRYLNLWHHLLSGRNWAALGDKETGWFHSAREDGRVALSLDDVDMTTGCLTQDPGRRSEDTNWVGVDSCGQGVKKEQYWYIDYPDDVVITPRQPDAGTDPREGQQVELRSAAGTAVHLSGGSTEAGTSVQAAEPDGSGAQRWVMRSLGGGNWRIAASAKPDMVVDHNPGPHTTHLVQAEEGNANQVWQPKGAGGGWYTLVSSADGGCLTGGGAGEALAVTACDANNQAQRWKFRETGTGTQVGTIRGLEGKCVEPRGGSRDDRTPVALADCAGSDAQAWTVSDDGSLQSLAKCLQVDGGRADNRTAVQLYTCNGSPAQKWIYTARQELRNPNSGKCLDVPDSDTSRPLQIYDCNRRDSQKWQLSARPVGQPDGGDAGDPFDAAPDDRGTKPAASGDCRPEGMAVTPGVAARYCDVYDGAGREWVGNNRTRRVVGYFTGWRAGASGDPKYLASNIPWSKVTHVNYAFAEVRDNRISIGDPNDPANPATGMTWPGEKNAMDASLPYKGHFNLLNTYKKKHPAVKTLISVGGWAGTRNFYAMTTNADGSVNQAGIDAFADSVTDFLDRYGFNGVDIDYEYPTALPDTGNPLDWDVSNPRRKGLQQGYNALMKSLRERLDRAGTDKGRYYLLTSAGSSSGYLVRGLDAGQALQYQDYVDVMTYDLHGSWNRFVGPQAPLYDDGRDNELADAGIYNDQAPDTKDFQKEGYFNVDWAYHYYRGALPAGRINLGIPYYSRGWRDVQGGTDGLWGTAAMPDQAQCPLGTGGRGPANAQSCGTGAVGIDNVWHDLENEREVGAGSNPLWHTKNLQDGRTPGYLRSYGVDTNLPSGQLTGTYAEKYSDALQSPWLWNDAKKVFLSTENEKSLDAKARYIVDKGIGGAMIWELAGDYAQRPGGEWGMGYDLTTRLDNAFKGAGATGNTKAGGRPQPAEVIDVKAELVDFPTGEKDFYPVQPKLRITNNSGVTLAQGTEIALDLPTSMPPVVKDNDYKEMKGLVPGHTGPNTGGLKGDFHRLTLTLGYCEDLAPGKSRDIDLKYYLPITGPSNVTFRIGGREYGSTGDQRRDVRTVTPPAPAAGSSCQAPDWKQGQVYRPDGGRLWRMYDKGDKGWMFEYGDSPAGKPMMIDNNPDQSRAHLVELMEQNANQYWRIQPAGGGLYTIAGGGRCLTATASRQDLASVGCDGRPEQKWRLVPIADNGSEGAPGGPKHNGLFKLRSAAGSDIELAGGATARETHLLTGDPAASTAAFVKYQGSYWYAQWYTTVAPGTAEANGGRPWKKLSPAPHHHHHH

SEQ ID NO: 583 - protein, 2581 aa, Artificial Sequence
  Optimized for E.coli
MGQGVPEYHYDGKLWSAGPTYKTPSVGGHPLAGRTPATPKTTKPLRTYRPARPAWPSAGTSTIALTQSAKSSATTSTPQHQTADGPATSPVRAGKLPVWVAPAKQAAKKRGAAPSTPAAVRVQLAGHAQAQAAGVDGMLLGLARADGAASSGRVAVTLDYSALDKAYGGGFASRLHLVSVPGCILTAPQKPSCRVRTPLASTNNPVARKLTATLNLPRPTTSGAAGASAHAGGTAGSASVAPMTAVEAISGASGSQGDYTATSLNPSGSWSANGTGAFTYSYPVAVPPSLGGAAPSVAFSYDSQSEDGETSARNSQSSWIGDGWSYSPGFIERSYKPCKQDGISDSADLCWGGWLATLSLGGHSGTLVRDESGNPDTPTANQTWHLQGDDGTKIEELGGADNGLWNGEYFKVTTTDGTAYYFGLNHAPGTTSDAATNSAWGEPVYSPKSGDPCYDSGQGKDSQCTMGYRFNLDFVVDPHTNVQRYTYATETNHYDRGGGQVAASGGSGTLTKYVRGGYLTEIDYGYQLTDETAGSKPGARVLFKTAQRCQTSSTFTDCSYANLNDKTATNWPDVPYDLNCASTDTTSGTGSNVCLTTAPSFWSTDRLDSVVTQVNVGGTLTDVDTYQLTQTYSDAGGTVDPVTGQSGKDAADEGELQSVMWLSSIQHTGDDTTGGGSTSPITLPKVTFLGTEIDNRIDGGNEPALFHPRMSSVTTETGESIAVTYSDPDCSRLNHTMPSAPDADTMSCYNVYWTIPGGVTPVSDWFNKTRVKTVTVSDGTGTGSPAQVSNYTYSGPAWHRDDSELTDDTYRTWDQFRGYRTVTVTTGAGSDPITQKTTTYLQGMDGDVRADGSKRSVSVTDSVGDTVTDSDWLSGTPLEADTYTQAGGSVVAKQIDLPQTFTTTATHNAGSSLPAVVARMIKTSQQRTYGLLADGSWREAETDTSYNGDALPTTVDAKGDVSVASQEKCATTSYATPPSGNPMMLSYPDEVLTVAGPCSTTPGTSTTVSDKRMFYDGDGTVTNVGTFGHLGTTGDLTATQIITGYSSGAPTYRTTQATAYDIYGRAIQVQDADSNTTKTAFTPTTGQLPTQLVTTNPRTWTTTSVMDPLRGLTMTSTDPNGRTTTIDYDALGRRTAMWLPGRPTSQSASRTFTYAVNDTAPTTITTNTLRDDSNYSTAIDIYDGMLQLRQTQSTTANNQAGRLISDTFYDSHGWARKTNSTYYESSTSPTNTMWVADDNQVPSQQVTVHDGLGRTTATQLWSKGAQRWQSTTAYPGVDRTDTTPPSGGTATSSFTNALGQTTATWMYDDTATPTGKASDAVVTGYTYTPAGQVATMSDNAGNKWTYSYDLLGQETKQTDPDTGTTTFDKYDDLGNLLQATDARGQILSYAYDTLDRKTAEYSGAWSATPDPSNELASFNYDTLAKGYPTSATRYVGGAGGDAYTQAVTGYTTDYQPTGGSTTIPTSTGFPSNSTGTNSNTYTVKYHYTPIMGLLSEADYGADGGLPAETLGYGYDLQGLLDGFGGNGTYLDTTDYTPLGQVKDTRWGLYGEQVEPTFSYDDTTGRVTQSQVNLQTSATSALDVTDYRYNQAGDVTAVSDTQSGGTTDTQCFTYDHLNRLTTAWTDTAGLTSAGVGSTGACTTSTPLASTTGGPAPYWQSYTYNALGDRTQQVQHDTAGNTANDITQTATYPGSGTTPATLANAATKITTTGPAGTATMTPAYNGAGDTTGRTVTTAGPLVSGQTRSGTKLCADDSSSGTTDGNKIDLYTCNGSTAQQWTIDTDGTVRVLGKCLDASGGGTTNGTKIDLYTCNKSAEQQWKAGANGSLVNPASGKCLDDPSASTTNGTQLQIWTCNGTPAQRWTNATMGTVLPGATQALGYDAEGRTASVTTPSGGKNQTTSYLYDAGGSLLLQTTPTSKILYLFGGAEQLTLSTSGGTVTGQRYYPGPDGITEVRSSAGTLTYEVSNAQGTATESLAASNLAVTRRYFDPYGNPRGPQPTTWTDNHGYLGKPADPTTGLNLLGARDYDPVQGRFLTADPLMEAGDPNQMSGYSYAADNPSTGSDPTGLHLACGDGDDPPCPSGGGASIGGMGGSSTTGGGGGGGGGTTTSSGGTAAAPSAGPACNVASKFGCDVVDAQQMADNGPPTSGTLRDFIAGALDEFVHQLEQLNPGWAMGNVPHDVANGMAPGIAGPPRYVEPRHVVAHTVHAHTNTDAYKGGEATTVLLEFAASGGDDAPEAAVSAVADAGDAQDGLAAAAEVKNVVSQTTGEATATAATPSEPATGASGTGEGPCSFSPSTRVLLAQGKTKAIAAVRPGDKVEAADPDTGRHRGPRTVQHVWINHDHDLLDVTIRTKGDHTATLHTTANHPFWDDTTHRWVPAGKLHHGDALKTSSNGHAYIVASHATPGTAKRWNLAVQQLHTYYVVAGGVSILVHNSNGPDSCPVLGAARAAADTASAITPGKARPAVAEALQLPGGQIYSSPSIRGVAPELHSDVQAILDDIPEGERGVGHGRCGLAVCVSDALSDGFNPTGSRAAAVIVRSSTDNPMHGMPVGPCDSCVALEDAFDIRFEGIGHHHHHH

SEQ ID NO: 584 - protein, 2575 aa, Artificial Sequence
  Optimized for E.coli
MGKLPPVQHIEPVPLTRVVAEQPAAKAAQPKTAPPVAAWPKPGQADVDLPPSRAQNPSPQAKAPGLPLTITSTGANPAAGEQAKVRVALSDRAAAAKVGLDGVLVNLEPVAGSTTPDKARVQLDYKAFRESFGADWGSRLTFVQLPECALTTPDQPQCRTATPVAASNDTKAGTLTADVAVAAPTGQTSDGPNKVSLAQAAGTSVAGATVLAATAEASGPDGNYKATSLSPSSTWSVSGNTGSFNWSYPIPVPPVPGDLAPQVALGYTSAAIDGRTASTNNQSSWIGDGWDYNPGFIERAYTGCAGDKGSGSNAPETGGDLCWKSDNATVSLNGSSSALVRDDASGTWKLSNDDGSRVEKLNGNATDTANGDTDNEYWKVTTTDGTQYFFGKNRLPGWSAGKPETGAALTVPVFGNQPGEPGYAPAFKDSSRDRAWRWQLDYVVDPHGNAIAYFYDQEKNAYAKNIGAATGTSKADALYTRAATLNRIEYGHRAGQVYNASPAGKVTFSTSDRCVETDCSFTEANAAYWYDTPVDQSCDKGQDCRNGAPTFWSKRRLTGISTQALQSNGSYKDVDAWSLDQDFPATGSSGGRALWLKTITRTAKAGSAQLTLQPVTFGGDLRPNRVDSAEGRSPMNRYRVNRITSETGSNTDVKYTDIDCVAGALPAPDSNTRRCYPSWWTPEGGAEPVFDWFHKYLVEKVTEHDLVAGSGSPDKVTAYEYLDGAAWRRDNSEFTPDKERTWNDFRGYQRVRTRIGDSGKSLTETVYFRGMDGDTLANGQPRPVSPLQGVKDSNELTGFARESIVYDKDDKDGGKPVTSTVNNPWLRSTASRAVKALPSKDNKTATPPAEKDRPEVAVLPPVTATMVRTESVTTNAFQPDGSTARTLRESRTFDSYGQTTAVSDEGDTNVTGDEQCTRTTYVTPDTTNWLISYPRSVQTTSTLCSTNATPATVTSEARTAYDSKPLGSAPEPGKGYATTTEALDRYDGTTPHYLTVSTTAYDQYGRATSVKDVNSAETTTSYTPASGSQATVVQSTNPKKFTTTTTNDGLRALPVKVVDANNRTTHVDYDALGRTTAVWNPGRDKNASPNVTYAYTVEPGKQPAVTTRTLLENGDYRTSIALYDGLLRPRQVQDEAYGGSEAHNGGRNITDSFYDSHGRIYRTNAAYHSTGTPEAALWIGLDNKVPSQTETEFDGLDRPTASIFKSQNKEQWRTTTRYGVNWGATTPPGGGTPTLTITDAHGRTSEVRQYKSGSPDFGADASAYETLKYTYNPAGKLTRFTDAAGNAWTWEYDLLGRQTKAVDPDRGTTTSSYNADGTLATVTDARGRTLAYTYDVLGRKTGMFDGSTTGPKLAEWAFDTLPGSNGLATGSTRWENGKAYTSGITGFDGAARPLGSTVTIPDSEGALAGTYTTAQTYTPNTGLGDTTTYPAGGGLRQESIHRDYTLLGLPTFVTDGGNQVYSQGNTYNEYGQITQSSIGRFGSGAYQTYVYEEHTKRLAQARTDGYSKPQTLNNKTYTYNQIGNITQVRDARGNPAVTDTQCYTYDFAQRLSNAWSATDNCVAQPTPTTDPYVGGVDPYWTNYTYDAAGNRTQATNRTSGAAPGPLMDTTKVTSVAIAGDGQTSAVAIADGQVYLSQQRADGTWANFENLHRTQAGPLPAPVDYVAAAWADNTLQIMAVAGGRIWHTLRGADGKWGGWGDVTSVVGSIANPSQLSLSATASGLEVLALSDGVLKHTLRKPDGNWSTWGSVYSETGSLTGATRVTSAATSTGLEVIVIAGDKLWHTVRYPNASWSKWGDVYSVNGALTSPTNLAATATAAGLETAVIAGGNIWHTLRKPDGNWTSWGNVSLVVGPLSQPTSAAVVSSLGDLKLITVAGGTLNYTKRSSSTGNWAPWSSLTQTPENPQTSQNQRTSTYPAPGGTRPHALSRVDITGTGARTDTFTYDDAGNTVRRVTADGDQALEWDTEGHLTKSTTAGKSTTFLYDANGNRLLRREPDAVTLYLDGQELKLDKTANKVIGTRYITVAGATIVKASDGTLNYLINDHQGTAQLTISADNLYTRGDTTPFGTPRGRKPASWPTERGFVGGTNDATTGLTHLGARDYDAANGRFISVDPVLDLTDPQQINGYAYSNNNPVNLTDPSGQRPEGICGGFGTCYDSKGNINTETFKREDDGTYTENYWNHWSGSKENPNVVSPHMHIIYRGGSLKQNVHGMFDSIQYIPGVSAIGAVGSAVMDAADGHYMSAAQNLAGAIPGERLFAMAGKAGKAAMAADRAEDVGNATADALSILSCDGAQAGAMHSFPPGTRVLLADGTTQTIESLQLGDQVQATDPTTGETESKSVIRTIRTPDDEHFTDLQLQVNASDGEPGAVETLTSTQHHPFWDETTHQWTNAAELTPGDTVRTVDGRTPTVLAVRNYDTAPQVAYDLTIADLHTYYVLAGATPVLVHNCGEPRFSVGSDGVVEDLANPLPVRGGYVPVPKLDGGTVPGVGNKIWGNSDPEHLIGTRSPEALRGIASKADAGKLQDFYAGAANAGKGGASGRGSQNSRNPVDTARNRVTLLQEIIDAWSHHHHHH

SEQ ID NO: 585 - protein, 368 aa, Artificial Sequence
  Optimized for E.coli
MDPAEVDRDTLNDPDFLKDKEALLYFSTAADQDTFGGGKSYAIFADEKGRLSSYHMKGLELGSAKVHDGSVLLEDKKGIYTVQGGLHTYKRAYQHTGDSAGYIERTKGFYTLYNSGYDKSGGSYRSELYRQIDGKWKQNVIPHYIRASGFFKDHLFALTPTDDEKGYHVQDIQADKEKLHTTSIATWTYKEGTSVESQLAADDSAVCFVTRGEKADHIYQMVKVMKNSGAIKTYDIAAYKNDEQTIYDSMPFSFKKSFFMERRSFYFVDGFGTVYRINPKTGKSKKAFALPASRMKADFKELTHQNGKLYLFTYSYKKPAKIESFDLKTGKKLNDRTIPNLKNIVTPKSHLKLYDVQVMGGFHHHHHH

SEQ ID NO: 586 - protein, 1049 aa, Artificial Sequence
  Optimized for E.coli
MANTLETVQVTATLPVGGGGAGGFGFGGGSGVHLSESQMDNGGGGGAIPTETAKEQPTDDKEKDCNGRKGNPVVLYSGNKVEPELDFASQGEMGLFLQRNYNHYWSATGLFGNHWLSNFDYSLAFTDANQLAWVQRPDGRRIKYLKDPASGRWYEDKAQPIAYLAANGDGTFTLRNENNGTEIYNAEGYITRLSNEQGVSWTFSYTDRYLQKVTHSSGRSISFGWTNGQVSQVTDPAGNIYRYTYTPNVFGNGRGRLASTTLPGAPATTISYHYEDGRFPGALTGKSFDGVRYSTFAYDAERRAISTEHNGGIERFRFSYAVRSTEPVLPPPAPARPGGVRADEERGWCEQRPGGSRICYQPRSLPVDSLPMESALGMTAAAAPSLTRPVDIDVTVINPLGRSTTYTFKDGKIVSTKGDPSPNCPASYKEQSYDANGYPDLVHDFQDNLTNFDYSAQGYLLKRVEAVGSTAERTTLQEWDTARNRLLKTTVVGDLEVAYTYDDRGNVASVTERNLTARGVPSQTRVTRTTYSYHANGLKASIKIDGPLPQDDVTSTFNNQGDLTSTTNALGHTISYSNFNGLGLPGRIVNANGGVRELTYDGRGRVVSDRTSSGTGWATTAIGYTSAGDIASLTQPDGVTVRYGYDAGRRLTHEVRSLGDGTWAWTRHSYNNASNRTRTEVSQTDYPIDTAVKGMIDEITHDGQWNWFARGWACSTGSAGSIQVDGYAEGNVYLGSTQANLASEPGVAAACQASGNGYRYQLPISLAQRQQLGGRKFSIYGVSPKGAQHNQALGNSGNFAIPTATIIGDVAGVTNDANWNFSVQGWACSVGVNAATTVHIYAGGPAGAGTYLGSVTGTLVPNDDVKAACQSQGAYWFGFTLDSNMRNAHGGKPIYVHGISPSGQAHLLLNRSGTFTVPAIVRNAEVVGASAYPYQIFNGGSSTLIFEFRNTSNVVWNPGDTYLAFGLNQPNENIALSAPVPPGGVARFSRSVGPNNPGSGNRTFSYVARMASGGVAWGAEAKVFLSVENNKGSCGRVVCERPRHHHHHH

SEQ ID NO: 587 - protein, 1049 aa, Artificial Sequence; identical to SEQ ID NO: 586
  Optimized for E.coli

SEQ ID NO: 588 - protein, 324 aa, Artificial Sequence
  Optimized for E.coli
MGSTAETDLVETPAADPRVEVLPARDVPLGGPRAMTVRRTLPQRSRTMIGAWCFVDHYGPDDVAGTGGMDVAPHPHTGLQTVSWLFTGEIEHRDSLGVHAYVRPGEVNLMTSGRGIAHSEVSTPATTVLHGVQLWIALPEEHRHTGRDFRHHAPAPVTLDGGEARVFLGTLAGDTSPVPTFTPLLGAELTLRPHAVVTLDVDPAFEHGLLVDNGEVRLLDTPLRPAELGYVAPGRRTLTLTNTGATDARLVLLGGTPFEERIVMWWNFIGRSHEDIARAREEWQAASDRFGTVQGYPGDRLPAPELPGVPLKPRGNVRHHHHHH

SEQ ID NO: 589 - protein, 810 aa, Artificial Sequence
  Optimized for E.coli
MAPAPAAAGAPLVDGGSYQLGSALDGSCLGPQYAQPAPGTPVLGAACGRLLSQRWQLRRTGGDYLLVNAASGRCLTLGGPDLRPATADCGSAPEAERFTVSRAPQGTYTLTVRGTGACLTADPAPVNHHCDHRPAHRWTLTRTEPLVLADPGFEQSSGSGAPTTGAPTTGAPTTGAPAADSSSAADSSSATGGPSTAAGWTFTAHTGTATNNPHGGSRLAYLDAGPGYTVSQQVTAVTAGTYDLSAWIATGGAGGSLSVSVNGTVVRSLPLPEQSTYAKYTLPRVRVAAGDRLTLTIGSSPTGWVNVDDAAVAPSAPNDPVISSSDPEVVALFDWAKTKANSWVQQPGATGVLDQDENHPGGTGTTTYDASYWAGYPFRSAFYSRDFAHQLVGAHLLGLDAENKTMLRGFAASATDVNRLYPVWALNFDARSYAAIDYRGPDRFVRELPAPFELVQQAGEAFRWTGDRDYAEDPGLGRYVRNTLGPFIAARPGPVDNGGVPIPQATSRSIFAGTASYAENATRTYAEAGDAVGAQYQAYLAAATLAEARGDAASAAGYRKAADQLHTYVNTTWSVDGSRPGEVVHGYDTTGKPITGWGYEASVLMPVKRLLDPGPRRDGFLAAVDAADSGPERSANLEAYTYLPDAFFANHDGTTAWKWMRHIYESTGEPHVSGAMLNGDYPEVPFTLLAQTVQGLLGVTPDAAGHALTTAPQLPSSMGWLQVAGIPVGAGTVTVRHDGAQRSTVTNTGTERLTWEARFPGQHARVTVDGAPREARTTTVDGVTYTSTTVTLAPGRSATATVTDHHHHHH

SEQ ID NO: 590 - protein, 1396 aa, Artificial Sequence
  Optimized for E.coli
MESTSDQKQAQEKKTDDVTVLQEKSDLKSTGTNPSEVVVANGKKGSELFDFEAFIKPSDIVDGTAPFDSNDEAGNDSSPNNGIVRTFDTVTYPLKVTINPKKNETLKNIKMKITGTLENGITNKRVNAKFAVGGKEDLEKGIVSFDMEYTLKETGNSLMIPVTVEVQGAEHGLKLKPNIKIQVISVDGKDIANENVSQSFDGISPVTTSGKVNVKARFTASYGGMPRLDYKVYDPNAKEDDRTIIYPVALDLFVNNLPNRTDLRGATFPAGKINYHFNFSGKVDWDYKSLGAETLNFEGRDKPIKIFNYQAIDKIVDKVPQEGTESFEIGMKGYKDPRTETANSPKSYIPKDIWNASDIDKYTIDSVWDSGTVRLNKPEITKDRVGYTGSIEDYVIGSTFPTMMSRPGYSVIPTFGKNEKAFSSTRFLIHSTNEYYPVLGKNNKDNLPNNVFYYLEFVIDSYEDGKGNTIPYNTVGRYTLTERNNPKGAYSIQTTFHTTDHKELGTPNVGYSAVSKGDPTVIVGQNVKVVSHLNVRAVTEGGTTMIYKWNTDSFYLSKNSAETARKNMLNEGYPNTSAGRVTNSDKQKIYFGISKKGDNSFETLTQNKDEDYDWYSTYDEAKKQGEVAAIKNDINASMGDGEVVAWNIPLEVKTKKIGSVNEKGTPNITVTDSIVYPSADRKVGYRVRGEGKYNNFTEYDEKGNITKLQSPVGSTVNFETLGIMNGETSSDVKTNKNTYYSSDNVSVTVDNLVKLPDAMDYNSLDEKVEMRVKIPKGLDYVVGSAKYGDQYIEPKIEQQNDGSNHLIWHDTLTRGNKTLKKINFETRINPVLLPQGNQVGLEITNVLSSAMDTRAEKFRTSSKNISVVKIGMVGVSETIEKVTGKKNSDYVVGVQPYTTIKDESHIKALTYVPRNKDHNGSAFNGVTFLRQIALENANNKNVEIWLNNSFVESNNPNKIDLKSNGWYRYTGEQDLSKVVSILLYINDSLSSSDIVKMNLVYGTHKNEFGDFYVSKTVVNTSVDYKLSPVSNQVKYTIVADANLGLRKIRIDTAPADIGLPVIVRLDKDIIYEDSNKSNVAVNLYDKSDNKLVDSKVYTIQELPEEIKFKVDPKFLKKNNKRNYEVRFEKVNKESIFIVDGKGKVDTDGYTSSEETVKANTKASTELKYKGVIMTEREVGKEMEVFYETLTIPLKQLPKQKTGYGFELKPLVSYNNELAVSYDVKTNALVDKRLIDSHLNYEKKGDQFVVPLEEAEKTGSTDKKNTDYLFELPHINVEQKTGNLFTDQQVKDHDPRIKNAIKDGKRKLYVPIWADLGEYNVLIVSGIPIGANKVNFEVTQPLNLYAYMYGTIGSKTLEDDELLLEPVDPKNPFSNGKPPGWSDVDVAWLKQHHHHHH

SEQ ID NO: 591 - protein, 228 aa, Artificial Sequence
  Optimized for E.coli
MGKEKETARYAKEIADLQQGTTPQDVLQSAKELAKQKHVSTEAILKQFHQEITADKVQGNVIVSKEGLSAMGGSSGTKKLPKSTKGNIYYTNSYTAYYNHGHVGMYSSADKIVESVPGDGVRQIAYNGREVEDNSIVQTVKVTDAQKQAAADWAVSRVGDEYSFNFVNNRNTGHEGAKNCSKLLWSAFLLKAGIDIDSNGGLGVYPRDITSSSYTTTILTIHHHHHHH

SEQ ID NO: 592 - protein, 661 aa, Artificial Sequence
  Optimized for E.coli
MAVTCTSPVWRVQYFGNSTFSGTPKLTACDSAISENYGYGDPTGVTLPKDNFSVRWSLTRDFGSGGPFRLSAATQDGMRVYVDGVRKIDLWKDVSTTARKGVDLTVPAGKHTIRVDHVAWTGLVYAGFTYAPRTAAAVDTVKPLAPTGLTAAYNRDTTKTTLRWAANKEMDLAGYRVYRRLSTTQWAKASGSSLLNSPSFVDATPATGQSFLYEVRAVDKAGRESAGSLDAIAATVDRTGPAAPTGLTVASDAWWATLAWQAGADAARYEVYAASAAAGPFELLGTTTTTSYRTDASVNTARYYRVRALDALGNPSAYAAVTGDGVDRTPPKSPTSLGSVVRVGDTEVYWKQPDGFYEDFDNGGTYRVYRSPGKTLDLAALTRVTCAEESDETSTGGICHDLDVPAGTYVSYAVVAVDPAGNESAPSAPLVVRTGDRVAPGPVAGVKATPRTDGVLMSWAASTEDDVERYVAWTGARQADGTVKWLSSTSCAEGTSDPLAVLCGDLPDGETYVYAVVAKDRWDNALPPNDSKVTVVEATEPDVRPSVTVTRDWDLGSMGYDTIIGGPDLDGPYINWRCDKTAECDTVTGYRVSRWNAATKAYEPLHAGLLAAETRAYTDTTAARGTTHFYMLEAVRADGSVVGTHVWSCVFQDRVHHHHHH

SEQ ID NO: 593 - protein, 661 aa, Artificial Sequence
  Optimized for E.coli
MAVTCASPVWRAQYFGNTTFSGTPKLTACDAAVNENYGYGDPTGVTLPKDNFSVRWSLTRDFGSGGPFRLSAATQDGMRVYVDGVRKISLWQNVSTTARKTVDLTIPAGKHTIRVDYVAWTGLAHAAFTYAPRTEAAVDTVKPLAPTGLTAAYNRDTAKTTLRWAANKEMDLAGYRVYRRLGTTQWARAGGSSLLTSPSFVDATPATGQTFLYEVRAVDKAGRESVGSLDATAVTVDRTGPAAPTGLTVTGDAWWATLAWQGAADAATYEVYAASAAGGPFELLGTTATTSYRTDAPVNTARFYRVRALDALGNPSPYAAVTGDGVDRTPPKSPTSLGSVVRVGYTDVYWKQPDGFYEDFDNGGTYRVYRSPGKTLDPAALTPVTCAEGSDETSTGGLCHDLDMPAGTYVTYAVAAVDPAGNESALSAPLVVRTGDRVAPGPVTGVTATPRADGILMRWSASTEDDVERYAVWTGVRQADGTVKWLTTASCREGTSDPLAVLCGDLPDGETYVYAVVARDLWGNALPPSDPKVTVVEATELDVRPSVTVARDWDLGSLGHGTVIGGPDEDGPSISWRCDRTAECDTVAGYRVSRWNAATQAYEPLHVGLLPAQTRDYTDTTAARGAAHFYTLQAVRADGSVAGTYVWSCVFQDRVHHHHHH

SEQ ID NO: 594 - protein, 644 aa, Artificial Sequence
  Optimized for E.coli
MAVTCASPVFKRQFYANTGFSGTPKKTDCDSAINENWGAGAPASGLPSNNFGVRWTVTRDFGSGGPFTFTAAAQDGIRVYVDGKRKIDLWKNVSSTQTKTLNLTIPSGKHTLRVDYVNWTGSANVKFTYAPRTSATVDKVKPLAPKGISVAYGKATNKARLTWAKNAEMDLAGYRVYRRLSTASTWTKVGTTTATSTTAYTDSPPATGKSYVYEVRAYDKAGNTSTGSADLSVTAITLATPTGLTATGADAGIAVSWQPVAGAVKYRLAHDDSGAYTTVTGTSYTDSSVARSVYRSYKVAAVDASGHVSAYSAVTAQVRRPVAAPYGMVASAASGTGVYRLYVNWTVNTATGGAYDTFHVYRSTSLPVDTTAEPFVCDDLSYNIGDDERGYSCRDEQVAPATTYHYVVKGVDDTGTESLPSATVSVATPTPDTTAPAPVTGLTATPTKYGIELDWADNAESDVVRYVVYRGVPAGDGDGQSCGSLGQIGTAFKSQYTHLTLPDGGRNCYLVDAVDDAGNSAYTATGQATTVHVTELDVRPSVASPTEPPVTVNGFYDTSFGRVELSWNVRYPYDTNKYYVYRWNPATQAYEKLTTTPLTTKRYFDTTAEPGTTHFYWVTVAYTNGESEPGSTYVIRQPHHHHHH

SEQ ID NO: 595 - protein, 728 aa, Artificial Sequence
  Optimized for E.coli
MAVTCSAGVWKAQYYANTTLSGTPKATVCDSAVAENYGSGDPSGVTLPNDNFGVRWTTTRNFGSGGPFDLSLAVQDGARVYLDGSRKIDLWRNVTSTQRKTVRLTIPRGSHTLRVDFAAFTGTANISFSYAPVIGATYDKTVPLSPVGVKSSFSASTLKTTLTWSRNYEMDMAGYRVYRRVAGTSSWSLRNSTLITGTTFNEAPPATGAAYEYALRAVDRSGNVSPLSAVTSVVSADRTAPAVPTGLTATYDPSAGARLAWSPASGASSYEVQRAVAPEGPFAPVGAPLQGAALTDPAAAVGTTYYYRVRAKDGAGNASAYSAPVRLDAAEAKPLPPTAVSATGRLDRNTVGWQYDGDASHQFHVYGADSAAGPWTRLTDTPVAGTSYDDHAAPVGEARYYQVRTVTTLGTESDPSTTASATRIRDVTPPHMPYGLDAWDATDGVHLVWTPNTDDTDHYLVMRKTMFGAWEQIAVVRDGTYLDTSTAPDVQFGYTVRAVDGAGNVSPLPEPGYGTVYGKRLPVYEKPAAPASVTATADNGNVKVEWTPSTSTDVAGYYVYRTTVTDPTTAYSVSPLITGTTFTNVDVPAGNSWYYVVRVVSTHSQWSDYSPMAAVTVPCPVLTGPPTPRITGGGRGADYAQLNWQVGTCDQGATVSYNVYRSTSSADVFTPERRIATGVTALTYKDPGLARAYYYYVVTAVAADGTESAPQATPFGISMMAPHHHHHH

SEQ ID NO: 596 - protein, 385 aa, Artificial Sequence
  Optimized for E.coli
MGFILAAAVLCFFYFRTEEPAEVDREILNAPDFLKNKEALLYFSTAADQDTFGGGKSYALFADKKGRLSSYQMKGLELGSAKVHDGSVLLEDKKGIYTVQNGLHTYKRTYQHTGDSAGYIERTKGFYTLYNSGYDKSGGSYRSELYRQIDGRWKQNVIPHYIRASGFFKDHLFALTPTYDEKGYHIEDIQADKEKLHTKSIATWTYKEGTSVESQLAADDGAVCFVTRGEKAEHIYQMVKVMRKSGAIKTYDIATYRNDEQTIYDSMPFSFKKSFFMERRSFYFVDGFGTVYRINPETGKSKKAFTLPASRMKADFKDLTHQNGKLYLFTYSYKKPAKIESFDLKTGKKLNDRTIPSLQDIVSPKSHLKLYDVQVMDGFHHHHHH

SEQ ID NO: 597 - protein, 661 aa, Artificial Sequence
  Optimized for E.coli
MAVTCTSPVWKAQYFGNSTFSGTPKLTACDSAISENYGYGDPTGVTLPKDNFSVRWSLTRDFGSGGPFRLSAATQDGMRVYVDGVRKIDLWKNVSTTARKTVDLTVPAGKHTLRVDYVAWTGTANAAFTYAPRTEAAVDTVKPLAPTGLTAAYNRDTTKTTLRWAANKEMDLAGYRVYRRLSTTQWARAGGPSLLTSPSFVDTTPATGQTFLYEVRAVDKAGRESAGSPDATVATVDRTGPAAPTGLRVTSDAWWATLSWQAGADAAKYEVYAASAATGPFELLGTTTTTSYRTDAPMNTARYYRVRALDALGNPSAYATVTGDGVDRTPPKSPTSLGSVVGFGYTDVYWNQPDGFYEDFDNGGTYHVYRSTGKTLDPAALTRVTCAEESDETSTGGKCHDLGMPAGTYVTYAVAAVDPAGNESALSAPLVVRTGDRVAPGPVTGVKATPRTDGVLLSWAASTDDDVESYVVRNGTRQADGTIRWLGTSSCWEGTSDPLAVLCGDVPDGETYVYSVVARDRWGNALLPSDPKVTVVEATELDVRPSVTVTRDWDLGSMGYDSLIGGPGVKGPSINWRCDKTAECDTVAGYRVSRWNAATKAYEPLHAGLLPAETRAYTDTTAVRGTTYFYTLEAVRADGSVAGTHVWSCVLQDRVHHHHHH

SEQ ID NO: 598 - protein, 644 aa, Artificial Sequence
  Optimized for E.coli
MATTCAAGVWKASYYANTTFAGTSKLTVCDTAISESYGTRDPAGVTLPRDNFGVRWTMTRNFGSGGPFTFSVAVQDAVRVYLDGTRKINLWSNVSSTRSKTVNVTVPKGTHTIRVDFAAFTGSANVKFGYAPKTSATVDKTAPLAPTGARVSYDQASSKATFTWSKNKEMDLAGYKVYLRRPGTSTLVVRTTATSYTTTLPATGAVYRFGVDAVDRAGNTSSSGIDLPVTTADRTAPQAPIGLTAADSQWDVTLSWTASEAGSTFRVYRADSTTGPYSLVGTTKSTWLTLTDAPYSTPRHYKVTATDVSGNTSAASAVLSYTRPTAVPWLYHAENNEADTGIRLLWEARLNAGTTGFRVYRAEPGSADPSWHAVTCEDFGQGGSTPYVQVHYCTDRSAVARTAYQYTVTSVDAKGRESERSVPYSITRVDRTPPPAVTGVTAKATPYGVVLDWDPSTAPDIAKFIIRREPEEKLPCWCNLAEVDAATTHFVDAELPDGETLTYSVDAVDTSGNSLYTLYLNPEDEGMTFADVTELDLTPSVDTPAGAPLDLTATAADSGHTVELRWDAIGEATGYRVHRWNPDAAAYEPLTAEPVTDLSYTDTTAATGTTHFYWVTAVYADGTESAPGAAWTILQPGSHHHHHH

SEQ ID NO: 599 - protein, 658 aa, Artificial Sequence
  Optimized for E.coli
MAVTCTSPVWRAQYFGNSTFSGTPKLTACDTAISENYGYGDPAGVTLPKDNFSVRWSLTRDFGSGGPFRLSAATQDGMRVYVDGVRKIDLWKNVSTTARKTVDLTIPAGKHTLRVDYVAWTGAANAAFTYTPRTEAAVDTVKPLAPTGLTAAYDRTTAKTTLRWTANKEMDLAGYRVYRRLSATSWAKVSGTSLLTTRSFVDAPPATGQTFLYEVRAVDKAGRESTGSPDVTATTVDRTGPAAPTGLTVATGDGWWDTLNWQGVADTAKYEVYASSAAAGPFELRGTTTTTSYRTSGAVNTNTYYRVRALDAAGNPGAYATVTSDGVDRMPPKSPTGVTAGARPGYTNVHWSQPDGFYEDWDNGGHYRVYRSPGKTFDPTARTQVTCVAEESHEASNGGNCYDVDMPANTYVTYAVTAVDPYGNESAYSAPVVVRTGDTVAPGPVTGVKVTPRNDGMLVSWAASPEDDIDEYVVWTGVRQADGTVKWLGPATCAEGTSNWLAILCGNLPDGEAHVYAVTAKDHWGNTLHPSDPKVTVVEATELDVRPSVTVTRDWSLGSLGHNRTTTRPSVDWQCTDTTRCATVTGYRVSRWNPATKAYEPQHDGLLPADARTWEDATATKGNTYFYTLEAVTADGAVVGTYPWYTVFQDRVHHHHHH

SEQ ID NO: 600 - protein, 647 aa, Artificial Sequence
  Optimized for E.coli
MAVTCTSPVWTAQYFANTSFSGTPKLTACDSAIAENMGSGDPAGVTLPNDNFSIRWSLTRDFGSGGPFRLAAATQDGMRVYVDGVRKINLWTNVSTTARKTVDLNIPAGRHTIRVDYVAWTGSAYAGFTYTPRTEASVDTVKPLAPTGLTAAYSRDTAKTTLRWTANKEMDLAGYRVYRRLSTTPWAKVSGSSLLTTPSFVDTPPATGQTFLYEVRAVDKAGRESTGSVDVTAATVDRTGPAAPTGLTVVSDAWMATLSWQAVSDAATYEVYASSAATGPFELLITATTTSYRTSAPTNANQYYRVYATVAGDGVDRTPPGSPSGLNSVARPGSTAVYWTAPGGRWVEDWDNGGHYRVYRSPGKTFDPAARTEVACAEEGSNEAGNGGACVDLGMPVNTYVTYAVTAVDPDGNESAYSAPLVVRTGDTVAPGPVTGVKVIPRSDGMLVSWAASPEDDIDEYVVWAGARQADGTVKWLGPDRCWEGVSNPLAILCGNLPDGETRVYAVIAKDHWGNGLHPSDPKVIAVEATELNVRPSVTVTRDWNLGSLSHNPTAARPSVDWQCTDTTRCGTVTGYRVSRWNPATKTYESQHDGLLPADARTWTDLTATKGNTYFYTLEAVTADGAVVGTYPWYTIFHDRVHHHHHH

SEQ ID NO: 601 - protein, 942 aa, Artificial Sequence
  Optimized for E.coli
MGHHHHHHDDVMAMNYHVQGDRIFLSGDVTYADVVSLPALLAKAQAEGRPVREVVLRTSNGGALIAGEWLQGIIRTSGLNTIVSGNCISSCSIMQSGGVERYLAGDLPLIDSVQIHAASSGGKVIYTPSPRMTQIYTGNYGGGMDAGLLHKAMYEVVKPNGLLVFRDPARSTGSSVTFDPDGSGSKLESFPGQDIYSNRIITANGYRDPGDTLNVTANVTGDINPGYLRTGRQLQAFVDDDFARWNTDWRSTYINLAQSIYNASSKGPQGIGALSVQGYLSDPDIQDLLLSKLRLADLDVSTLDNAMGVIRVTNGATWRTSATTGADFMLVDNGTIALEGGALRASEVRVLGAGMLVGHGDVAGTAMDRAALLDGTGPSYREDGFNRLRVFGTLMPRGGDLVTHGYVNIMPGGKVLFDVTENGGTAAGRLRVGTFFDDEQTEGALVISKGAFLELNVAQGYYGQDFRRDLVKGPIYQGGFEEAVRLGDTGYSASISGDVFRPRHNSLLSFNVKQTADGLWLTANPGFDQLGLFANGTSGDGLGRALATASDRQDKGLRSLLGALQFADRDVIAQQAGALRGDAHASLRLADTALVGSIGNVVQQHQSAMRSGGDADGLASQVAQSVSSQPGMRHGSLFNQLAMHLVEPAPGSVAGSGDAGRSHGIWARGFASHGRIDAGGGVAGLSHNIGGVVVGADTRVADDRVTLGVSVAAADMSTKASDGSGFTGDVRALDVGGYLDATYARGYLSAAVRYTDLRHDTRRSIGGIDGLQQPLRAKYSNDAISARVEHAFSFTNGKGLVIQPLLPVVDYARTSATRFNEGQGAGALVGRSGSLESIRVGAGLQLFKTFEGNNGERITPRARVVWQKELGDSQARYSTGFAAAPDLMFGASSQAVGEQVLAWNLGVTSRASERLSIMADYVGERRDGQIQNGVMLGLGYRF

SEQ ID NO: 602 - protein, 661 aa, Artificial Sequence
  Optimized for E.coli
MAVSCTSPVWKAQYFGNSTFSGTPKLTACDSAIAENYGYGDPPGVTLPKDNFSVRWSLTRDFGSGGPFRLSAATQDGMRVYVDGVRKIDLWKNVSTTARKTVDLTVPSGKHTLRVDYVAWTGTANAGFTYAPRTEAGVDRVKPLAPTGFTAAYNRDTRKTTLRWAANKEMDLAGYRVYRRLSATQWAKVSGSSPLTSPSFVDATPATGQTFLYEVRAVDKAGRESAGSLDATTVSVDRTGPATPTGLTVAGDNWWATLAWQGPADAAKYEVYAASAATGPFTLLGTTTTTSYRTEAPVNTLRYYRVRALDVSGNPSAYAAVTGDGVDRTPPAKSPTSLGSVVNVGDTEVYWDQPDGFYEDFDNGGSYRVYRSPGKTLDPAALTGVTCAEWSDETSTGGKCHDRDMPAGTYVTYAVAAVDPAGNESALSAPLVVRTGDRVAPGPVGGVKATPRADGVLVSWAASTEDDVERYVVRNGTRQADGTVKWLGTASCWEGTSDPLAVLCGDLPDGETYVYAVVARDRWGNALSPSDPKVTVVEATELDVRPSVTVVRDWDLGSLGHGSLIGPEQDGPSIGWRCEKTAVCDTVAGYRVGRWNAVTKAYEPLHAGLLPAETRAYTDTTAARGATHFYTLEAVRADGSVAATYVWNCVFQDRVHHHHHH

SEQ ID NO: 603 - protein, 661 aa, Artificial Sequence; identical to SEQ ID NO: 602
  Optimized for E.coli

SEQ ID NO: 604 - protein, 945 aa, Artificial Sequence
  Optimized for E.coli
MGHHHHHHAVDDVMAMNYHVRDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGRITYAPSPRMTQIYTGNYGGGMDAGLLHKAMYEVVQPNGLLVFRDPARTTGTSVTFDPDGSGSKLETFPGQDIRGNNIINTAGYRDPGDTLRVTSNVSGDINPGYLRTARQLQAFVDDDFARWNTDWASTYINYAVSLYNVSTRGPNGIGTPSLQQMLADPDLQDELRGQLRLADLDASTLASSAGVIRVSNGATWRTAETTGADFMLVDNGTIALEGGALRTPELRVMPGSVVVGHGDIASVGTDSDALLDGTGPSYREDGFNRLRVFGTLMPRGGDLVTHGYVNIMPGGQVLFDVTETGGTGSGRLRVGSFYDGGSEEGALVIAQGAHLALNVAQGFYAGTYRRDLVEGPIYQGGFQDAVRLGDTGYSASIAAGEVFRPRHNSLLSFNVNQTADGLWLTANPGFDQLGLFTNGTSGDGLGRALAAASDRQDSGLKSLLGALQFADRDVIAQQAGALRGDAHASLRLADNALIGSIGNVVQQHQAAMRSGGDADGLASQAAQSVSSQPGMRHGSLFNQLAMHLVEPAGEGAGDSRTASGSRGLWARGFASHGRIDADGGVAGLSHNVGGILIGADTRVADDRVTLGVSVAAADMSTKASDGSGFSGDVRALDVGGYLDATYSRGYLSAAVRYTDLRHDTRRSVGGIDGLQQPLRAKYSNDAISARVEHAFSFTTGKGLVIQPLLPVVDYARTSATRFNEGQGAGALVGRSGSLESVRVGAGLQLFKTFEGNNGERITPRARVVWQKELGDTQARYSTGFAAAPDLLFGASSQAVGEQVLAWNLGVTSRASERLSIMADYVGERRDGQIHNGVMLGLGYRF

SEQ ID NO: 605 - protein, 661 aa, Artificial Sequence
  Optimized for E.coli
MAVSCASPVWKAQYFGNSTFSGTPKLTACDSAVNENYGYGDPTGVTLPKDNFSVRWSLTRDFGSGGPFRLSAATQDGMRVYVDGVQKINLWKNVSTTARRTVDLTVPAGKHTLRVDYVAWTGLAHATFTYAPRAEAAVDTVKPLAPTGLTAAYNRDTAKTTLRWAANKEMDLAGYRVYRRLGTTQWVRAGGSSPLASPSFVDATPATGQTFLYEVRAVDKAGRESVGSLDATAVTVDRTGPAAPTALTVTGDAWWATLAWQGAADAATYEVYAASAATGPFELLGTTTTTSYRTDAPVNTARFYRVRALDALGNPSPYASVTGDGVDRTPPKSPTSLGSVVRVGYTDVYWKQPDGFYEDFDNGGTYRVYRSPGKTLDPAALTRVTCAEESDETSTGGLCHDLDMPAGTYVTYAVAAVDPAGNESALSAPLVVRTGDRVAPGPVTGVTATPRADGILMSWAASTEDDVERYTVWTGARQADGTVKWLTTASCREGTSDPLAVLCGDLPDGETYVYAVVARDLWGNALPPSDPKVTVVEATELDVRPSVTVTRDWDLGSLGHGTVIGGPDEDGPSISWRCDKTAECDTVAGYRVSRWNAATQAYEPLHAGLLPAQTRAYTDTAAARGTTHFYTLEAVRADGGVAGTYVWNCVFQDRVHHHHHH

SEQ ID NO: 606 - protein, 661 aa, Artificial Sequence; identical to SEQ ID NO: 605
  Optimized for E.coli

SEQ ID NO: 607 - protein, 660 aa, Artificial Sequence
  Optimized for E.coli
MVTCASPLWKAQYFGNSTFSGTPKLTACDSAIAEDYGYGDPAGVTLPKDNFSVRWSLTRDFGSGGPFRLSAATQDGMRVYLDGVRKIDLWKNVSTTARKTVDLTVPAGRHTLRVDYVAWTGAARAAFTYAPRTEAAVDTVKPLAPTGVTATYDPGTTKTTVRWTANQEMDLAGYRVYRRLGSTSWARVGGASPLTSRSFVDATPATGQTFLYEVRAVDKAGRESAGSLDATAVTVDRTGPAAPTGLTVVGDAWWATVAWQRVADATTYEVYASAAPAGPFALLGTTSTTSYRTDAPENTTRYYRVRALDALGNPSAYATVTGDGVDRTPPKSPTSLGSIADVGATRVYWKQPDGFYEDFDNGGTYHVYRSSGTVLDAAALTRVSCAEQSDETSTGGICHDLDMPEGAYVTYAVAAVDPAGNESALSAPLVVRTGDRVAPGPVTGVKATPRADGVLVSWAASPEDDVERYTAWTGVRQADGTVKWLGSAFCREGTSDPLAVLCGDLPDGETYVYAVVARDRWGNALLPGDPKVTLVEATELDVRPEVTVTRDWDLGGTGYGTVIGGPEEDGPSITWRCDKAAVCESVAGYRVSRWNAATKAYEPLHSGLLPAATRTYTDTTAARGATYFYTLQAVRADGGVAGTHAWSCVFQDRVHHHHHH

SEQ ID NO: 608 - DNA, 2856 bp, Artificial Sequence
  Optimized for Arabidopsis thaliana and Solanum lycopersicum
atggaagatacaaagggtgaacaagtttcatacagaaatgttttgaagatggaacctgttggagttcaacttccagttcaagagcttgctcattcttcaaaggttcttgaatctaaatcatttgaaaagagattgcaatttgctgatctttcacaaagaccacctgaagttaagaaagaatcaaaacaacttgctgttgctaagacatatactattgctgagcttaatcaattgtctaatcaacaacttgttgatcttttggttactattgattgggagcaaattactggtcttttccaattcaatactgattctttggctttctaccaaaatgattcaagaatgcaaactattattgataagttgaagcaacaaggacaagcgtacactaaagatgattcaaaaggtattgagacattggttgaggttttgagatcaggattttaccttggattctataattcagaattgtctaaattgaacgagagatcataccatgataaatgtcttcctgctcttaaagctatggctaataactctaattttaagttgggtactcttgagcaaaatagagttgtttcttcatacggaaagttgattggaaacgcttcttcagacgttgaaacaattacttctgctgctaaaattttcaagcaatacaacgataatttttctacacttgttgataatctttcagctggtaacgctatttacgatattatgcaaggagttgattacgatattcaatcttacctttacgatacaagaaaggctcctaaagatactgtttggtatcaaaagattgattcatatattaatgagttgtcaagatttgctcttatgggtacaattacagctaagaatggttggttgattaataacggtatttactatacaggaagacttggtatgtttcattctacaggaacaaaaggacttcaagttgttacagatgctatgaagatgtatccatatcttggagagcaatactttgttgctgctgaacaaattgctacaaattacggtggaaaggatgctaatggtaaagttgttaatcttgatcaaattagagaggatggtaaaaagaagtatcttccaaagacatatacatttgatgatggagctattgttttgaaggctggagataaagttactgaagagaaggttaaaagactttattgggctgctaaggaagttaaagctcaatttcatagaacagttgaatctgatcaaccacttgagaagggaaatccagatgatgttttgactatggttatttacaattctcctgctgaataccaattcaatagacaattgtacggatacgaaactaataacggtggactttatattgagggaacaggaactttctttacttacgaaagaacacctgaagagtctatttactcattggaggagctttttagacacgagtttactcattaccttcaaggtagatacgaagttcctggtttgtggggtcaaggaaagatttacgaaaacgagagactttcttggtttgaagagggtaacgctgagttcttcgctggtgctacaagaacagataacgttgttcctagaaaatctattattggtggtctttcatctaatccagctgagagatatacagctgaaagaacacttaacgctaaatacggtacatgggatttctacaattattctttcgctttgcaatcttacatgtataataagagatacgatatgtttgataaaattcacgatcttattagaaagaacgacgttacagcttacgacgcttacagatcaacactttctaaagacgctaatcttaataaggagtatcaagattacatgcaaatgttggttgataatagagagaaatataatgttcctttggtttctgatgattacttggctaatcatgcttctaagcctgtttcagatattgctgctgaaattactgctgaagctaaattgaagaacgtttctgttaagaagaataagcctcaatttttcaatactttcactcttcaaggtacatatacaggaacagctgctaagggtgaatatgaggattggaagacaattactcaaaatgttaatgatactttgaagagactttcagctaaggagtggacaggatacaaaactgttactgcttatttcgttaattacagagttaatacttcaggtcaatttgagtacgacgttgtttttcacggtattaatactgaagagggagctgagaataaggctccagttgctgttattaacggtccttattctggaaacgttaacgaggctatttcattcacttctgacggatcaaaagacgaagacggaaagattacttcttacaagtgggagtttggagacggtgctgtttcaaacgagcaaaatccaactcacgtttatactaaagagggaacttatacaactaaacttactgttactgacgataagggagctactaatacagctacagctactgttactgttcaaaagaaggaagataattctgttgaaaaggagcctaataactctttccaaacagctaataagttgcaacttaatcaagttcttagagcttcacttggtaatggtgacacttctgatttctttgagattaatgttgaaactgctaagaatttgcaaattaatgttactaatgagaataacattggtatgaattgggttttgtattcagaggctgatcttaataactacgttacttacgctcaacaacaaggtaataagttggttggatcatactatacatatcctggaaaatattaccttcatgtttaccaatacggaggtggaacaggaaattatacagttgaggttaagcatcatcatcatcatcattaataa

SEQ ID NO: 609 - DNA, 2304 bp, Artificial Sequence
  Optimized for Arabidopsis thaliana and Solanum lycopersicum
atgggaaagaataacgatgttccattttataatggtcaaaatgattctttccttacttctttgaatcttcaattgccaggaaaatactatagaccaggttcaggatacgctgctaaggagtcactttacagagctgacgttcatttccctgctgtttacaacggttctttcaattgggataatcctagagagaatcttgttcaagctgaagatacatcagagccttacattagaattgctaacgagggataccttaattctaaggttccagctggagatagaatggttacagaagttgagagagttaataactctgttatttcatctaaatactggggaaatcctgagttcgttcttgaaaatatggataagcatatgattcaaacatacgagtctttcagagaacttggtcaattctattggattagagatattgcttatttgtctggaggatacgctggtgcttctggtgttggaaatattaataagtactctttgtggtacgttagaacttctaaaccacaagttaaagattttcaagctatgtcaggaaagaaagatattccagttaaattcacttttaagggtttcgagtacgtttctaaaaataagggttacaacgatagagatcctaacggtactacagttaatccataccaaaaagctgctggtgaaagaaatagagttaagtggatgcttgatattactaaggacggtgaaacagtttatcatcaagaaaattatcttagatcaactcctcaaaaggataatcaaaaacctaacgagggagacgctggacaattcaagaaagaggatattacttggcaacctcaactttgtggtcaatatacagctaaaattaaggttcttgacgctgttcaaagagaatcaaacgagaaagctgttgattttactattgacggtaattgtggaactgaggttacaccaaatcctgatccaggagacgaagacgatttcaaatacaaaattgatttttctgctgatagaattgaaggagagacagctagagaaggtaaaaatattaaaactagagttgacgtttcaagagataatttcaaattggaaagagatcaatacagagctaaagttaataacaatattaataagtcacaacaagagattaattctacagaatcagatagagattcagctcaatcttctttgtcatattgtagaagaaatccaattcacgaggttgacgctgaaggaaaagatcattactacgatagagattgttcttgggaggaaaataagttggattcagctgcttcaaagttggataatgctagacaaaaattggaaaaggagaagaataagattaaaaaattggatgttttggaggaaaagtacatgaatccagaaacagttgttgttttgaaacataatggtcaacaagttgctttgcaaaaggttagattgactgagggagagaaaaagacattgaatttggattggcaacataaaggaaagggaacaattcaagctgagattaatcctgctggaaatagaattgatattgaggagactacatacaaaaataacccaattaagactgctatttacgaaccttcaaaggagaaagctatgtgtggagttacttctgttaaaggagttgttgagacagtttcagagagagtttctaaagaagatattacaggtgctatgtactatgagacattgactggatcaattggtaatcttgctccttcaaaattgcattcaggttacggattttcttacgaggttaatgggaagtacaagaatgattggaatgctaattaccctggtgtttttactgctgctaaagctcaatacccttttgctgatgagggattgaaatcaacacaagatttggagaagaaggagcttaaggatactacagctaagttcttgccaaagaatatgtacctttcagaggctactggtcatgttttcgattcaaagagaccaactaagtctttgtactgggatggtcaagagaagattattgatggtggacaaaagtggtattctcctttgaagactaaaaatggtgtttacacttttaatgttgaaactgctccagctggtattaatgagatgtcactttgtttgactgagcaagttgagattaaaggagttgcttacgatgatttcattaaaagaagagttttccctgatgatccattccctggaggttcaggagttggatggaattgggttggtaaagaggatgttctttacaagttgactgattggtattatatgagaaatagaaaacatcatcatcatcatcattgataa

SEQ ID NO: 610 - DNA, 4194 bp, Artificial Sequence
  Optimized for Arabidopsis thaliana
atggagtctacttctgatcaaaagcaggctcaagaaaagaaaactgatgatgttacagttcttcaggagaagtctgatttgaaatctactggaacaaacccatctgaagttgttgttgctaacggaaagaagggttctgagcttttcgatttcgaagcttttattaaaccttctgatatcgttgatggtacagctccattcgattctaacgatgaggctggaaatgattcttctcctaataacggtatcgttagaacttttgatactgttacataccctttgaaggttactatcaatccaaagaaaaacgagacattgaagaatattaagatgaaaatcactggaacacttgaaaatggtatcacaaacaagagagttaacgctaagtttgctgttggaggaaaggaagatcttgagaaaggaattgtttctttcgatatggagtacactcttaaggaaactggtaactctttgatgatcccagttactgttgaggttcagggagctgaacatggtttgaagcttaagcctaatattaagatccaagttatttctgttgatggaaaggatatcgctaatgagaacgtttctcaatcttttgatggaatttctccagttactacatctggaaaggttaacgttaaagctagattcacagcttcttatggaggtatgcctagacttgattacaaagtttacgatccaaacgctaaggaagatgatagaactattatctaccctgttgctttggatcttttcgttaataaccttccaaacagaactgatttgagaggagctacattccctgctggaaagattaattaccatttcaacttctctggaaaggttgattgggattacaaatctttgggagctgagacacttaactttgaaggtagagataagccaattaaaatcttcaattaccaggctatcgataagatcgttgataaagttcctcaagaaggtactgagtctttcgaaattggtatgaagggttacaaagatccaagaactgagacagctaactctccaaagtcttacatccctaaggatatctggaacgcttctgatatcgataagtacactatcgattctgtttgggattctggaacagttagattgaataagcctgagatcactaaagatagagttggatacacaggttctatcgaagattacgttatcggttctacttttccaacaatgatgtctagacctggatattctgttattccaactttcggaaagaatgagaaagctttttcttctactagattccttatccattctacaaacgaatactacccagttcttggaaagaataacaaagataatttgcctaataacgttttctattaccttgagttcgttatcgattcttacgaagatggaaagggtaacactatcccatataatacagttggaagatacactttgacagagagaaataaccctaagggtgcttactctatccagactacattccatactacagatcataaggaacttggaacaccaaatgttggttactctgctgtttctaaaggagatcctactgttattgttggtcaaaacgttaaggttgtttctcatcttaatgttagagctgttactgaaggaggtactacaatgatctataagtggaatacagattctttctacttgtctaaaaattctgctgagactgctagaaagaatatgcttaacgaaggatatcctaacacttctgctggtagagttacaaactctgataagcaaaagatctattttggaatctctaagaaaggagataactctttcgagactttgacacagaataaggatgaagattacgattggtattctacttacgatgaggctaagaaacaaggagaagttgctgctattaaaaacgatatcaacgcttctatgggagatggagaggttgttgcttggaacatcccacttgaagttaaaactaagaaaatcggatctgttaacgagaagggtacaccaaacatcactgttacagattctatcgtttatccttctgctgatagaaaagttggttacagagttagaggagaaggaaagtataataacttcactgagtacgatgaaaagggaaacattacaaaattgcagtctcctgttggttctactgttaacttcgagacacttggaatcatgaatggtgaaacatcttctgatgttaagactaataagaacacatactactcttctgataacgtttctgttactgttgataatttggttaaacttcctgatgctatggattacaactctttggatgagaaggttgaaatgagagttaagattccaaaaggacttgattacgttgttggatctgctaaatatggagatcaatacattgagcctaagatcgaacaacagaacgatggatctaatcatcttatctggcatgatactttgacaaggggtaacaagactcttaagaaaattaacttcgagacaagaatcaatccagttcttttgcctcagggaaaccaagttggtcttgagattactaatgttttgtcttctgctatggatactagagctgaaaagttcagaacatcttctaaaaatatctctgttgttaagatcggaatggttggtgtttctgagactatcgaaaaggttacaggaaagaaaaactctgattatgttgttggtgttcagccttacactacaattaaagatgaatctcatatcaaggctttgacatatgttccaagaaacaaggatcataacggatctgcttttaatggtgttactttcttgagacaaattgctcttgagaacgctaataacaaaaacgttgaaatctggcttaataactctttcgttgagtctaataacccaaacaagatcgatttgaagtctaacggatggtatagatacacaggtgaacaggatctttctaaggttgtttctatccttttgtacatcaatgattctttgtcttcttctgatatcgttaagatgaatcttgtttacggaactcataagaatgagtttggagatttctacgtttctaagactgttgttaacacatctgttgattataagctttctcctgtttctaaccaggttaagtatacaattgttgctgatgctaatttgggacttagaaaaattagaatcgatactgctcctgctgatattggtcttccagttatcgttagattggataaggatatcatctatgaggattctaataagtctaacgttgctgttaacttgtacgataagtctgataataagcttgttgattctaaggtttacactatccaagaattgcctgaagagatcaagtttaaagttgatccaaagttccttaagaaaaataacaagagaaactacgaggttagattcgaaaaggttaataaggaatctattttcatcgttgatggaaagggtaaagttgatactgatggatatacatcttctgaagagacagttaaggctaacactaaagcttctacagagttgaagtacaaaggagttattatgactgaaagagaggttggtaaagagatggaagttttctatgaaactcttacaatcccattgaagcagcttcctaagcaaaaaacaggatacggtttcgagttgaagcctcttgtttcttacaataacgaattggctgtttcttacgatgttaaaactaacgctttggttgataagagacttatcgattctcatttgaactatgagaagaaaggagatcagttcgttgttccacttgaagaggctgaaaagactggttctacagataagaaaaatacagattacttgtttgagcttcctcatatcaacgttgaacaaaagactggtaatttgttcacagatcaacaggttaaggatcatgatccaagaattaagaacgctatcaaagatggaaagagaaaactttatgttcctatctgggctgatcttggagagtacaatgttttgatcgtttctggaattccaatcggtgctaataaggttaactttgaagttactcagcctttgaacctttatgcttacatgtatggaactattggttctaaaacattggaggatgatgaacttttgcttgaacctgttgatccaaaaaaccctttctctaacggaaagcctccaggttggtctgatgttgatgttgcttggcttaagcaacaccaccaccaccaccactaataa

SEQ ID NO: 611 - DNA, 513 bp, Artificial Sequence
  Optimized for Arabidopsis thaliana
atggctatcgatgtttatttgcaaatcgatggaatcaaaggagagtctactgatacagctcataaggattggatcgagtgtagatctgttcaatgggaagttcttcagcctaaatctgctactgcttctacaggaggtggacatactgctgagagaacagaacataaggatatcgttgtttctaagttggctgatcttgctactcctcttttgcttcaaaactgttcttctggaaaaacaatcccaaaggctaaatttgagttcttgagagctgatggacagggtgaaagaattaagtacttcgaaatcgagttggaaaacgttcttatctctaacgttgctccatctgttaacgctggagatatcctttctgaatctttggctcttaagtactctaaggttaagtggaagtacactcaacagaaggttggtggaggttctggaggtaatacttctggaggttgggatttgtctgctaacaagacagctcaccaccaccaccaccactaataa

SEQ ID NO: 612 - DNA, 2835 bp, Artificial Sequence
  Optimized for Arabidopsis thaliana and Solanum lycopersicum
atggctgctgacgacgttatggctatgtcatatcacgttcaaggagatagaatttttctttctggaggtgttacttatgctgatgttgtttctcttccagctttgcttgctaaggctcaagctgaaggaagacctattagagaggttgttcttagaacttctaatggtggtgctcttattgctggagaatggttgcaaggagttattagaacttcaggtttgaatactattgtttctggacattgtatttcatcttgttctattatgcaatcaggtggagttgagagatatttggctggagatttgcctattgttgattcagttcaaattcatgctgcttcaaattcaggtaaagttatttacacaccttctcctagaatgacacaaatttatacaggaaattacggtggaggaattgacgctggacttttgcataaggctatgtacgaagttgttcaaccaaacgggttgttggtttttagagatccagctagaactacaggagcttcagttacatttgatccagacggatcaggttcaaagttggaatcattccctggtcaagatatttattcaaatagagttattacagctaagggatatagagatcctggagatacacttaatgttactgctaatgtttcaggagatattaatcctggatatttgagaacaggtagacaacttcaaacattcgttgacgacgattttgctagatggaatactaattggcaatcttcatacattaatcttgctcaatctatttataatgcttcatctaatgggccacaaggtattggtgctaattctgttcaagattaccaaaatgatcctacatacaaggctttgcttctttcaaagttgagacttggagatttggacgtttctactcttgataattctatgggagttattagagttactaatggtgctacttggagaacatcagctactacaggagctgatttcatgcttgttgataatggtacaattgctcttgagggaggagctttgagagcttcagaagttagagttatggctgctggtatgcttgttggaaatggggatgttgctggtactgctatggatttgtcagctcttgcttctggtactagaccttcatggagagaagatggtttcaatagattgagagtttacggaactttgatgccaagaggtggagatttggttactcatggttacgttaatattatgcctggaggaaaagttctttttgatgttacagagaatggtggagctggttctggaagattgagagttggttcattctttgattctaaacaaactgacggagctttggttatttctaagggtgctttcttggaacttaacgttgctcaaggttactacggacaagattttagaagagatttggttcaaggacctatttaccaaggtggattcgaagaggttgttagacttggagatacaggttattctgcttctattactggtggagaggtttttagaccaagacataattcacttctttcttttaatgttaagcaagctgctgatggtttgtggttgacagctaatccaggatttgatcaattgggtttgtttactaatagaacttcaggagacggtttgggaagagctttggctacagcttcagatagaagagatggaggtcttaagtcacttcttggagctttgcaattcgctgatagagatgttattgctcaacaagctggtgctttgagaggagatgctcatgctacattgagattggctgataatgctttggttggttctattggaaatgttgttcaacaacatcaagctgctatgagatcaggtggagatgctgatggattggcttcacaagctgctcaatcagtttcagctcaaccaggaatgagacacggatctctttttaatcaattggctatgcatttggttgaacctgctgctggaggtggtgaaggttctggaccaggaagaaatcacggactttgggctagaggtttcgcttcacacggaagaattgacgctgacggtggtgttgctggtttgtcacataatattggtggaattgttgttggtgctgatacaagagttgctgacgatagagttactcttggagtttctgttgctgctgctgatatgtctacaaagggtagagacggatcagatttctctggagacgttagagctcttgacgttggaggataccttgacgctacttactcaagaggttatctttcagctgctgttagatacactgatcttagacacgatacaagaagatcagtttcaggtattgacggacttcaacaacctcttagagctaaatattctaacgacgctatttctgctagagttgagcacgctttttctttcacaacaggaaagggtttggttattcaacctcttttgcctgttgttgattacgctagaacttctgctactagattcaacgagggacaaggtgctggagctcttgttggtagatcaggttctcttgaatctattagagttggtgctggacttcaacttttcagaacttttgagggaaataacggtgaaagaattactcctagagctagagttgtttggcaaaaggagttgggagattcacaagctagatattctactggttttgctgctgctcctgatcttgtttttggtgcttcttcacaagctgttggtgagcaagttcttgcttggaatttgggtgttacttcaagagcttcagagagactttcaattatggctgattacgttggagagagaagagacggtcaaattcaaaacggtgttatgcttggattgggttataagttccatcatcatcatcatcattaatga

SEQ ID NO: 613 - DNA, 1989 bp, Artificial Sequence
  Optimized for Arabidopsis thaliana and Solanum lycopersicum
atggctgttacctgtgcaagtccggtgtggcgtgcgcagtactttggtaacaccacattttctggcacaccgaaactgaccgcttgcgacgcagccgttaacgaaaactacggttacggcgacccgaccggcgttacactgccgaaagacaacttttcagtgcgttggagcctgacacgcgactttggttcaggtggcccgtttcgtctgtctgctgctacccaggacggtatgcgtgtttacgtggacggcgtgcgcaaaatttcactgtggcagaacgttagcaccacagcacgtaaaacagtggacctgaccattccggccggtaaacacacaattcgcgttgactacgtggcatggacaggcctggctcacgcagcctttacatacgccccgcgtaccgaagcggctgttgacacagtgaaaccactggcaccaacaggcctgacagcagcatacaaccgtgacaccgccaaaaccacactgcgctgggcggctaacaaagaaatggacctggcgggttaccgtgtttaccgtcgcctgggtaccacacagtgggctcgcgcaggtggtagcagtctgctgacctctccgtcatttgtggacgcgaccccggctaccggtcagacctttctgtacgaagttcgtgccgtggacaaagcgggtcgcgaaagcgttggcagtctggacgcaacagccgttaccgttgaccgtacaggtccagcagcaccaaccggtctgaccgttacaggtgacgcatggtgggcaacactggcttggcagggtgctgctgacgcagcaacctacgaagtttacgctgcttcagcagccggtggcccatttgaactgctgggcaccacagcaaccacaagctaccgtacagacgctccggttaacaccgcacgcttttaccgtgtgcgcgctctggacgcactgggtaacccgagtccgtacgctgctgttacaggtgacggtgtggaccgtacaccgccgaaatctccgacctcactgggtagcgttgtgcgcgttggctacaccgacgtgtactggaaacagccggacggtttttacgaagactttgacaacggtggcacataccgtgtttaccgctctccgggtaaaacactggacccggcagcactgacaccggtgacctgtgccgaaggtagtgacgaaacctctacaggtggcctgtgccacgacctggacatgcctgctggtacatacgttacatacgcagttgctgctgtggacccagcaggcaacgaaagtgccctgtctgcgccgctggttgtgcgtacaggtgaccgcgtggctccaggtccagttaccggcgtgacagctacaccgcgtgcagacggtattctgatgcgctggagcgcaagtaccgaagacgacgttgaacgttacgcggtttggacaggtgtgcgtcaggctgacggtaccgtgaaatggctgaccacagcgagttgtcgtgaaggcacatctgacccgctggctgttctgtgcggtgacctgccggacggcgaaacctacgtgtacgctgttgtggcacgcgacctgtggggtaacgcactgccgccgtcagacccgaaagttacagttgtggaagcgaccgaactggacgtgcgtccgtcagttacggttgctcgtgactgggacctgggcagcctgggtcacggcaccgttattggtggcccggacgaagacggtccgtctatttcatggcgttgtgaccgcacagccgaatgcgacaccgttgcgggttaccgtgtgagccgctggaacgcagccacccaggcatacgaaccactgcacgtgggcctgctgccagcacagacacgtgactacacagacaccacagctgctcgcggtgcagcacacttttacacactgcaggctgttcgtgctgacggtagtgtggcaggcacctacgtttggtcttgtgtgtttcaggaccgcgttcaccaccaccaccaccactaataa

SEQ ID NO: 614 - DNA, 1812 bp, Artificial Sequence
  Optimized for Arabidopsis thaliana
atgcaagatatttctggatctcagggttctactacaaatgagtttaatccttggtctccacaaaacggacatccttatagacatggtgctgttccaggaatgtctcaacatgagaattacaagaaatggcttgctgctcataaccaggctgctgctacaggtcaacagactttgtcttatggaggtggagttgatggaatcggtgttcagtctggacattctaaggtttatcttgttttctacggtaaccaatggggaactcagactacagatgctggtggaaatgctaagttttctaacgattctgctggagctgctggtgctacacaacagatgttcaaaggaattggtacaaatggtgaaacttggtctgctgatttgacacaatggtgtgatggtcctaacgttgctactggagctgtttcttgtccttctaatgctaactttatcccatatcaatctggtggagttctttctggtgtttggtacgataatgctgctgcttctccatctcaggcttctggaaaccaattggctcaggaggctgttaaagctgctggacatttcggtaatactacagctgctgctaacagagatgcttattacattgttctttctcctcatggaactaatccagatgattatcaaaaccctactacaggttactgtgcttggcatgattggaacggagatactacattgacaggtggagctgcttcttctccttatggagatattgctttttctaatcagccatacaacatcgatgctggatctaattgtggagttggtttcgttaactctcctggtactcttgatggatggacaatgactttgggtcatgaatggcatgagatgatgtctgatcaaaatccagctggtggatggactaaccatgtttctggttcttcttataacggacaagaaaactctgatgagtgtgcttggattcagcctggatctacaggtggagctgctaacatctcttttggagctttcggttcttacgctgaacaagcttcttggtctaatgatacaaactcttgtgctatttctcatgctatccttactcatggtaatgctgttacagttacttctccaggaaaccagtctggaacagttggtactgctgtttctcttcaaatcaatgctactgattctgctactggtcagactttgggatactctgctacaggtcttcctgctggattgtctattaacgcttctactggtttgatctctggaacaccaactgctgctggtacatcttctgttacagttactgctacagatactacaggagctgctggttctactacttttacttggacagaatctacaggtggaggtggaggtaacgctattactaacggaggtcttgagacaggttctttgactggatggactacagttggttctacatctgctactgctcctgctgctcattctggaggttatggagctatggttggatctacaggtcctactggagattcttctatcgctcaaacttttacagctccaactggtacatctaagctttctttctggtactctaacacttgtgatgatactgttacatacgattgggctactgctacacttaaagataacactacaggaactacaactacagttttggctaagacttgtactacaactggtacttggacaaataagactgctacagttactccaggacattcttacacacttactttgtctaaccatgatgataactatcctggagatccaacatacacttattacgatgatgttactgtttctcaccaccaccaccaccactaataa

SEQ ID NO: 615 - DNA, 2403 bp, Artificial Sequence
  Optimized for Arabidopsis thaliana
atggctggtcagcctgctccagctacttacacagttgctgttggtagaacaggatcttatgcttaccctgatgatactcaagcttctccatacactgataaggatggaacattttacttccaacagtctcatgctctttatggtgctaaagattctagacaatgggatttctttacaggaagagattttgattctgctactagatcttctgctatttctgatgctgttaatcctgctgatccatctgatagaaacgatgatactacagctagatgtaataactctcctactggaagacaatcttcttacgctccacagggttctcattacgctcaaagaaactactgtgatttggctggagtttgggttgatcctgattctggagcttggtatggtttggttcataatgagtttactcctcaaccattcggagatggacttcattatgatgctattgattacgctgtttctactgatcaaggtagaacttggacaattagagatcatgttatcacttctccttactctacagctagaggagatactgctgcttttccacaacagacattctcttatggagatggagatcaaagactttttgctgatactgcttctggatacttctacgttttctacggttctagaatcgttgataagggaggttcttggggtgctttccaacagcatgttgctagagctcctatgtctgctaagatggctccaggatcttggcagaaatggtatgatggagcttggtctcaaccaggtgctggaggtcttgaatctgatatggttcctgctgatggagctaatccaacaggttatttgcctccagctaaagagtacaatcctgctaacccaggaactgtttctagacaaatcgctgctggtacattggctccttctactccacttttcgttatgaatatctcttacgatgcttacttgggactttacatcggtacacctcaagctgttgatcagtctggtaacgctccacaacagatctatgctactaaggatcttgctactcagaagtggactcttttgggagatacaggaggttatcatactgcttcttggtacagatggttcttggattctgcttctcttactggatctacaatcgttggaaagacttttagatcttactgttctttcgcttgtgctggttctgatggacaatatgttgaattgactgttggttcttctgctcctgctgctcctccagttgatcttactagaacatacagaattcagaatggtaacggaagagttttggctcaaactgctggaggttctgctgttacttctacagctaaagctgctggatctgctagagaatcttggagatttttggctgagggagatggatcttatagaatcgttaatgctgctacaggacagcttttgggtgttgatgctacttctacagctggaagagcttggggtgctgctcttactgctacaggagctgttggaggagatgctactgttggtcaacagtggtttattttgccttctaaggctggtaaaggaagattccaattggttaacagatattctggacttgttatcggaatgtctggaacatctggtagacttgctgagactgctccagctagatcttggtctgatactacaggaggtacagttggaggtggaagaactgctgctgaacaggctttggctcttgctcctactggtacagctccagaggctgttgttttgacagctcctggagatagatctggaactgttggaaaggctgcttctgttcaattgggagctacagattctgctggtaaaccacttacttttacagctactggattgcctgctggtctttctgtttctccatctggacttattacaggtactcctacaggtccaggagtttctaaggttactgttacagcttcttctggaactgcttctggttctgctgatttcacttggacagttgaacctgatttgggtggaaatcatacacttactacaggtggaaaagctttggatgatgctgatcattctactgctgctggtaatccacttattacttggacagcttctggtggatctaaccaagtttggcagttcagacctcagccagatggatcttacgagttggttaacggtctttcttctatgtgtgctgatgtttctggtggatctactgatgctggagctcaagttatccagtggccttgttctggtggagctaatcaacattggaacgttagacttacagctgatggatcttattctgttacttctgctcattctggtcttttgcttactacagcttctggagctgatggtgctagagttacacaggagcctgatactggatctccattgcaaagatggtctatctctcaccaccaccaccaccactaataa

SEQ ID NO: 616 - DNA, 2436 bp, Artificial Sequence
  Optimized for Arabidopsis thaliana and Solanum lycopersicum
atggctcctgctccagctgctgctggagctccattggttgacggaggttcttaccaattgggatctgctcttgacggatcttgtttgggaccacaatatgctcaacctgctccaggtactccagttcttggtgctgcttgtggaagacttttgtcacaaagatggcaacttagaagaactggaggagattatttgttggttaatgctgcttcaggtagatgtcttactttgggtggaccagatttgagacctgctactgctgattgtggttcagctccagaagctgagagattcacagtttcaagagctccacaaggaacttatacacttacagttagaggtacaggagcttgtcttactgctgatccagctccagttaatcatcattgtgatcatagaccagctcatagatggactttgacaagaactgaaccattggttcttgctgatcctggatttgagcaatcatctggatctggtgctcctacaacaggagctccaacaactggagctccaactacaggtgctccagctgctgattcttcatctgctgctgattcttcttcagctactggaggaccttcaacagctgctggttggactttcactgctcatacaggaactgctacaaataaccctcacggaggttcaagattggcttaccttgacgctggtccaggatacactgtttctcaacaagttactgctgttacagctggtacttacgatttgtctgcttggattgctactggtggagctggtggatcattgtctgtttcagttaacggtacagttgttagatcacttccacttccagaacaatctacatacgctaagtatactcttccaagagttagagttgctgctggagatagacttacacttacaattggatcttcaccaactggatgggttaacgttgacgacgctgctgttgctccatctgctcctaacgatcctgttatttcttcatctgatccagaggttgttgctctttttgattgggctaaaactaaggctaattcttgggttcaacaaccaggtgctactggagttcttgatcaagacgaaaatcatcctggaggtactggtactacaacttacgacgcttcttattgggctggttaccctttcagatcagctttttactcaagagattttgctcatcaacttgttggtgctcatttgcttggtttggatgctgaaaataagactatgcttagaggtttcgctgcttcagctacagatgttaatagattgtatccagtttgggctttgaattttgacgctagatcatacgctgctattgattatagaggacctgatagattcgttagagaacttccagctcctttcgaacttgttcaacaagctggagaggctttcagatggacaggagatagagattacgctgaagatcctggattgggtagatacgttagaaatacattgggaccttttattgctgctagaccaggtcctgttgataacggtggagttccaattcctcaagctacttcaagatcaatttttgctggaacagcttcatacgctgaaaacgctacaagaacatacgctgaagctggagacgctgttggtgctcaatatcaagcgtatcttgctgctgctacacttgctgaggctagaggagacgctgcttctgctgctggatatagaaaggctgctgatcaattgcatacttacgttaatacaacttggtctgttgacggttcaagacctggtgaggttgttcacggatacgatacaacaggaaagcctattacaggatggggttacgaggcttctgttcttatgcctgttaagagattgcttgatccaggtcctagaagagacggattccttgctgctgttgacgctgctgattcaggtccagaaagatcagctaatttggaggcttatacttaccttcctgatgctttctttgctaatcatgatggtactacagcttggaagtggatgagacatatttacgagtcaacaggagaaccacacgtttctggtgctatgcttaatggggattacccagaagttccattcactcttcttgctcaaactgttcaaggattgcttggtgttactccagatgctgctggtcatgctttgactacagctcctcaattgccatcatctatgggttggttgcaagttgctggtattccagttggagctggaacagttactgttagacatgatggagctcaaagatcaactgttactaatacaggtacagagagattgacttgggaggctagattccctggacaacacgctagagttacagttgacggtgctcctagagaagctagaactacaactgttgacggagttacatacacatcaactacagttacattggctcctggaagatcagctactgctactgttactgatcatcatcatcatcatcattaatga

SEQ ID NO: 617 - DNA, 2127 bp, Artificial Sequence
  Optimized for Arabidopsis thaliana
atggctagagctgctggtcctgctactgttccagaacaagagtctattgaagctcagatcgctagagctgctgcttctggaaagaaacaagttgatattgaacctggagagtatagaagaggttctgttttggatctttctggattggatggttttacaatcaacgctaagggagttactgttgttcaaacaagacttgttcaggctgttagaacaggaacttctaataacttgacagttactggtcttactattaattacgatcctttgccattcacacagggaagagttatcggacttggaaagacttctgatggtaaaccttggatggatgttagaattgatgctggataccctagaccagataaaatcccttctagagtttctgtttatgatccagctttgagactttggagatctcaagcttacaacattccagttacttggcaggatagaacagctggtgttgttagatctatgggaggtgcttgggctgctggaactggagatatcgttgcttttgctggagaagctgagtctggtcctgatattgctatcggagttggaggtgctaataacacattcaaggatgttactttgcatacagctccaggatttggtttccaaaatagagctggagagggtaacactcatcttgataacttcagagttgttcctggtcctccacctccaggaggtacagagaaaccaattttgactacaacttgggatgctatgggattcggttgggttaagaaaggacctactgttgaaaactctacagttgttggagctggagatgattctatgtctgttcaaggatttggtactgctaaggttttgaaagctgatggagatacactttgggctgcttttgctgatggattcagaaatgctttgcctggagatagacttcaacagtggactgatggaccaacagcttctattagatctatcgctcctgagaaggatccagctattaaagctcttgctggtgctaaggctgatttcacttacaaattgacacttgatagaccttctccatggaacgctggaactgatatcacaaatttggatagaatcggatctggtttcgttttcagaaataacagaatcgattcttctggaagaggtttccttgttaaggctagagatggagttattgaaaataactggatgagaggtgttaactctatctctgttactcctgagaatacatctgatgctaacgctaattctggaggtaacttggttattagaggaaacacttttactggtacacttgtttctgctcctggaggttgggattcttgtcaagttggagctgtttcttttgatccaggttctgcttctagacctctttacccagatatcactatcgaagataacgttttccaggatattagaggaactggtttgaaccttggatctgctaagaacgttacagttagaaataactttttccaaagatctcatcaggctacttatcctgctacaaagaatagatgtggtatcccaaaatcttctgttgtttacgtttctaactctactggagttacattcgagggtaatactattgatagaatcggaccttactctgttcaacaggttacagttgatgatagaaaaccttctggaatttctggtttgccaggaggtgttaaggttttgaacccttatcttccagttaaagctgcttctacttacacaatctctaatagagattctaggcttttgcttgctcctgctggaggttctactgatgctggagctggtgttgagcaacagtctgctgctgatggttctgctcaaagatggagactttctccagctggaaataacaatacagttagaatccagaacgctgtttctggtttgtttcttactggaggttctgattctgctgttacacaacagccaagatctgatgatcaatctcagagatggagattgcttgatactggaaacggtacagctaagatctctaatgttgctactggaaaagttttgggtgctacagattctgctcctggagctccagctggtcaatggcctgtttctggagctcttgatcaggcttggaaattcactgatgtttctccacaccaccaccaccaccactaataa

SEQ ID NO: 618 - DNA, 684 bp, Artificial Sequence
  Optimized for Arabidopsis thaliana
atgaaggaaaaagagacagctagatatgctaaggaaatcgctgatcttcaacagggaactacacctcaagatgttcttcagtctgctaaggagttggctaagcaaaagcatgtttctacagaagctatcttgaagcaattccatcaggagatcactgctgataaggttcagggaaatgttatcgtttctaaagaaggtctttctgctatgggaggttcttctggaacaaagaaattgcctaagtctactaagggtaacatctattacacaaactcttatactgcttattacaaccatggacatgttggaatgtactcttctgctgataagattgttgagtctgttccaggagatggtgttagacaaatcgcttataacggaagagaagttgaggataactctattgttcagacagttaaggttactgatgctcaaaaacaggctgctgctgattgggctgtttctagagttggagatgaatactcttttaatttcgttaataacagaaacactggacatgagggtgctaagaattgttctaaacttttgtggtctgctttccttttgaaagctggaattgatatcgattctaacggaggtcttggtgtttacccaagagatatcacatcttcttcttacactacaactatcttgactatccatcaccaccaccaccactaataa

SEQ ID NO: 619 - DNA, 1011 bp, Artificial Sequence
  Optimized for Arabidopsis thaliana and Solanum lycopersicum
atggattacgatccaaagaagaaaggatggtacgtttacggtcacggacaagtttcagctgatggaaagcaagttgttcctgatgctaagactagagtttgggcttttcatggagctatgttcaatactggagatattttgccttgggatatgggatggcttcaagatgttattgattggctttctggagatcctgttgagttgacaactggaatgcttacagattcaagaacagatttggctgttggaggtacacttggatctgctgagattactagaacatactggcaaggagatccagagaagagagctttcggtattggaagagatttgtcttacaacgcttttcttcattcaaaaaagcaatggcaagaggttgatttgtaccttcctggaggttctaagactcatttcacaagaacatctactggaacagattggactaatgctgttttcgagccacttgattctccatctggtttcagaggttctaaacttgtttggaagggatatgatggtggatgggatttgacttttagagacggttctgtttgggtttttccacaatacgctcctcttaaggaaattagagatagacacggaaacgctgttaagattactagattggacggaaagagaggagatattactagaatttctgctcctggaggtagatggatttcacttgcttacgacgctcaacatagagttactggtacaaaggataacgctggaagaactactgcttatacttacgatacagctggtagattggatacagttactgatcctgctggtaaagtttcaagatatacatacgacggtactacaaatagaattagaactgctgttgacgcttgtggaattacttatatgtctaatactttcgacgctgctggtggatcaagaaatagaagatcaccaagagttagatcaacaccatcttcaactccaagacctgctagagctagatcacctagaagaccacatcatcatcatcatcattgatga

SEQ ID NO: 620 - DNA, 3864 bp, Artificial Sequence
  Optimized for Arabidopsis thaliana and Solanum lycopersicum
atggctccttcaccaacatctggagcttcatcatcaactccatcttctggtccaccttctgctcctccttcagctccacctcaagctcctccatcagaggctaagagagctgctgagagagctgctgaacctgctggacctgagcaaactccagctgctgctgctgctgctgctgctcctgctgtttcagatgctgtttacgcttatgatgctgctggaagacttgttggatcaacagatcctgctggagagactgctagatatagatacgatgaggctggtaatagacttggtattgatagattcgcttcagctgatctttctgttctttcattggttccaacaagagctgctgttggagctactgttactctttcaggtacaggattttctacaactccttcatctaatgctgtttcatttggaggacaaacagctgaggttgtttcagcttcagctacaagattgaaggttaaggttcctgctgctgctgttgctggaaaggtttctgttactactggaggtggaactgctcaatcacctgaatctttcacacttgctgctccagctccttctgttacaaaggttgatccaacatcaggatacgctggaacagctgttgttctttctggtgctggatttgctgctgctacagctgataacgttgttagattcggaggtggagttgttgctgaaattgttgaaagaacagatactgctcttaaggttttggttccagctggtgctgctactggtccagttgaagttgctactcctgacggtagaacaacttcagctgctgctttcagacttgttgctggagacggtggaggagagattgagacatctgttgagacatcagttacagacgagactccacctactgtttctgttactacaccaggaaatcaagctcaagttgttttcgacgctaacgctggagacgatatttcaattggttttacagagtctacattcaatcaaacagttacagttagattgcttgatcctcaaggaaagagattggaatcagctgcttatactggtactgctggagattgggagatgacagacgttcctgtttctggtcaatactcagttattgttgatccaggaacaggtaatattggatcagttaaagttacagtttctaatcctagaatttctgctcttgatcttgctggtccagctgttgacgctcaattcacaagacctggacaagatcatcttcttacatttgctgctttgttgggagattcactttcattgggaattgacgctactggacttgctaagtctacttacgctagactttacggacctgatggtgctgagattgataaggtttatgttactggtacaagaattggtggacttgatgttgatgctttgacacaatcaggaacttacacattgcaacttgatcctgatgctgctgctcttggaacagttaaggttactggatcacattacgctgatgctggtactttgactgctacaggtccagctcttgacgtttcacttattagacaaggtcaacaaggaagagctcaattttcagctcaagctggtcaaagagtttctcttggaggatctgctacaggattcggtaatttcacaagagttgagattcatcaacctgatggagctttgcttgattacttccttgttccagatgctgatgctggacaatgggattcagctactttgactacatctggaacatacactgttgttgttaaaccaggttcacctttggctactggaaaaatgactcttactttgtcaagacctttggctcttgctgctcttacaactacagcttctgcttcagctgttaatattacaagacctggtcaaaacgctgaatcatcttttcaagctcaagctggtgctgatttgtctttgggattcactgctaatactttccctcaatacattgacgttacagttacagctccatctggagctaaagttgttgacggtgttaacgttacagctggtgctgctactacaattccacttcctgttcttacagaagctggtacttaccaagttgttcttgatccaaataagggtgctgttggtgctacatctttgactttgtcagctgttgctagagctactcttacagctgacggagctcaacaacctacaacagttgctagagctggacaaagagttagagctacattcactgctcctgatactgctgctttgggacttgctgttactgctaatacaattgctgaatcaacagagattagacttattggacctgatggtggagctggagctttggctggaagagttgcttctaaggcttcagatactttctacttgacaggtcttacttctggaactgcttaccaacttgtttttgaacctgctaaggctacaacaggagctatgacattgtggttgtcaaaaccagttaaggctggaactttgtcaacaacagctcctactcttacaggagagattactagaccaggagctcaacttgaatttggtgttacagctgttacaggttacggtgctgctgttgttttctcaggtactacacttacagagacttcagctcttattcatcaaactcctggaggtgttgaagataatgttggatctctttctaaagctacacttgatgctgatttgagagctcctttggctgttggtggacatagagtttttgttagaccaaacggttcagctactggaaagacaactgctacacttgttcctaacgttactggaggtgctcttgctactacaggtactaagaaatcagttgctattgctacagctggacaaaatgctcattacactttcacaggaacagctggtcaaaagttgactcttggtcttgatacacctccaggtgcttggtctttgtcagttcacggtcctgacggaaagtggcttgttgacggtagaaatatgtctgctactacagtttcatacgctcttcctgctcttccagctaacggtacttatacactttcagttgatccaaattctcttaagactggaacatggaatttgggtcttactgctgctgctactcttagagctgctacagctgctgatactgctgacggacctgatactgctgagggagctgataaagctgctggagctgacgaaccagctactcctaagcctccagctgctggagttactcctactggagctgacgcttggcaaccagataaaggtaatctttctggacacgattggcttactagaagaggagacgctccaaaggctccaccaactcttagagctcctcctaagactacagctcttacaggtcacgttcttaagttggacggaaagcctttggctggagttactgtttctgctggagctaatacagctagaacagacgctgaaggaagatttcttttggctggtatttcaccagaggctacaactttggttgttgacggagcttcagctaatactaagcaaagacaatacggaagatttgatattagaattagacctaaagctgatacttcagttgatcttggattcccagtttggatgactcctcttgatatgaagaatacagttagattcgctgctcctgctaagactgacgttgttcttaaaactccaaagattcctggattggaagttagaatacctaagggttctgttgttagagacgagaaaggaagaccagttacagaacttggaattactgctattccaattgatagacctccattccctcttccagaaaacggtgttgttcctgttttctttacagttcaaccaggtggaacttacgttttcccagaaggagctgatagacttccagagcttcatgctcatcatcatcatcatcattgataa

SEQ ID NO: 621 - DNA, 1110 bp, Artificial Sequence
  Optimized for Arabidopsis thaliana and Solanum lycopersicum
atggaccctgctgaagttgatagagatactttgaacgatcctgatttccttaaggataaagaggctcttttgtatttttcaactgctgctgatcaagatacttttggtggtggaaaatcttacgctattttcgctgatgagaagggtagattgtcatcttatcatatgaaaggattggagcttggatcagctaaagttcacgacggttctgttcttttggaggataagaaaggtatttacactgttcaaggtggacttcatacttataagagagcttatcaacatactggagattcagctggttacattgaaagaactaaaggattctatacactttacaattctggatacgataaatctggtggatcttatagatcagaactttacagacaaattgatggaaagtggaaacaaaatgttattcctcattatattagagcttctggtttctttaaggatcatttgtttgctttgactccaacagacgacgaaaaaggttatcacgttcaagatattcaagctgataaggagaagttgcatactacatcaattgctacttggacatacaaagaaggtacttctgttgagtctcaattggctgctgatgattctgctgtttgtttcgttacaagaggtgaaaaagctgatcatatttatcaaatggttaaagttatgaaaaattctggtgctattaagacttacgatattgctgcttacaagaacgacgaacaaactatttacgattctatgcctttttctttcaagaaatcattcttcatggagagaagatcattctactttgttgatggattcggtactgtttacagaattaatccaaagactggtaaatcaaagaaggctttcgctcttcctgcttcaagaatgaaggctgattttaaggagttgactcatcaaaatggtaaactttacttgttcacatactcatacaaaaagcctgctaagattgagtctttcgatcttaagacaggaaaaaagttgaacgatagaacaattcctaatcttaagaatattgttactccaaaatctcatcttaaattgtatgatgttcaagttatgggtggttttcatcatcatcatcatcattaatga

SEQ ID NO: 622 - DNA, 2442 bp, Artificial Sequence
  Optimized for Arabidopsis thaliana and Solanum lycopersicum
atggttcattttaagaattgtcctgatccatcacttaacgctaattctcaatcacatcctgaattttcttctgagcttgaacatattaaggctagaatgcaaaattttattaagcattcagttacagatcaaaatattgaagttacagacgctagagttactgctgagggagaaattacatctttgcttaaagagagattggataaagagtactttaaacttttgtcaaaaattacaagagaggttaacgttgaagatttcggagctgttccagacggtagagataatacagaagcgtttagaaaagctattggaaacggtagagttaaagttaacgttcctgctggtgaataccttgttcaaggtattaaattgccatcttggacaactattgttggtcaaggaaagggtattactgttattaaacttcacgaagatactccagctcacgagtgggttattactaacgacgattatcaaaacggtaatagaaatatttttgttcaaggaatgtcacttgattggaatccttcaagacaatgtggagttagaaatcctggtggacaattttcatcttgtcttacattcgctaaggttgaatacggatggattaaggacgttgaggctattaacgctggacttcacggtattgatattacttcaccaacatacgatcatcttcctgatactgattggacaaaggacggatcaagatatatttggattgataattgtgttacttacggatctggagacgacggaattacaactcattactcagagtacatttttatttctaattgtcattctggaaatccaagaggaactgagtttgttgaaggtgtttcaaattctaacggtattgaggttgacgacggttcaagacacgtttggttgcttaataactttacttctggtaatattagaggagttgaggttaaggctcatgaactttggcctgcttcacaaaatgttcatattattggacatgtttcatacagagatgttagagctttcgatttgagacatattggacatcatcaaattacagatccagagtcaactacagcttacgacgttacacttattgattgttctgctattgagccagttttcaattctctttacgacgctgttactcctagagctcttgttatttcagcttacaaaaacgttaacgtttctggttttactgctattggagatccagattacgattacaagggtaatccagttgttgctcttcaatatagatcacaaaatattacaattaacggtattaagattagaggtttcaagaaagctggagttgatattaatctttctggtggttctaataagacagattacattaagatttcaaattttgatatttataagtctgctccaaagggaatttctattggtggaggactttacaatgttaatattcttaatggtactatgattacagataacggtactgttggtattcaatcaccaaataaccaagctacaattcttggagttcaatctgagggttattcagttgctgcttctattaagggacaaacttaccaacaaattccaattaatcttaagggaggtattcaacttgctactacttctggattcgctgttaatcaaacttcagctgttattgctggtacaggagatattactgctagaggtgaaagaaatgctgttatttcttcatctggaggatcttctactgagggatcaagagctttgattgcttcatcaaataacgctcatattaagggaaatcatgtttcaagaactattttgtcatcagagaatattattcttgaggaaccatatactgttgctggtggtcatcaatctatgaaatggcttttggattctgttagaggaaacggtacatttgctggagctatttcttcatcacttggtggttatggagagtattttgagtcatctacaggacaacttattcatactggaacaattgttactttgagaggagagaagattgctccagctgatgttggagattacatgttgggtgttatttcagaaacttctgcttttatttcaggagcttcttcattcgtttggcaaggaagatacttgactaacgagtttggtggttttatttacgaagttgttacagacgaggaatcaggtgaacttattagagttccaaagcaaaatccagattacgatacagctttggaggctaattaccattcaagagctgctagagatgagtggcatgttgttggtcttgttggaaagcattatgttagaattgatgaaactgtttctcaaggtaattatttgactgctcataatggtattggaactaaggctgctgaaggttcatggaaggttatgaagattacatctgcttatacttctgaaaagggttacggaattgctttgacagttattaagcatcatcatcatcatcattgataa

SEQ ID NO: 623 - DNA, 2055 bp, Artificial Sequence
  Optimized for Arabidopsis thaliana and Solanum lycopersicum
atgaaatacctgctgccgaccgctgctgctggtctgctgctcctcgctgcccagccggcgatggccatggctgttacctgtgcaagtccggtgtggcgtgcgcagtactttggtaacaccacattttctggcacaccgaaactgaccgcttgcgacgcagccgttaacgaaaactacggttacggcgacccgaccggcgttacactgccgaaagacaacttttcagtgcgttggagcctgacacgcgactttggttcaggtggcccgtttcgtctgtctgctgctacccaggacggtatgcgtgtttacgtggacggcgtgcgcaaaatttcactgtggcagaacgttagcaccacagcacgtaaaacagtggacctgaccattccggccggtaaacacacaattcgcgttgactacgtggcatggacaggcctggctcacgcagcctttacatacgccccgcgtaccgaagcggctgttgacacagtgaaaccactggcaccaacaggcctgacagcagcatacaaccgtgacaccgccaaaaccacactgcgctgggcggctaacaaagaaatggacctggcgggttaccgtgtttaccgtcgcctgggtaccacacagtgggctcgcgcaggtggtagcagtctgctgacctctccgtcatttgtggacgcgaccccggctaccggtcagacctttctgtacgaagttcgtgccgtggacaaagcgggtcgcgaaagcgttggcagtctggacgcaacagccgttaccgttgaccgtacaggtccagcagcaccaaccggtctgaccgttacaggtgacgcatggtgggcaacactggcttggcagggtgctgctgacgcagcaacctacgaagtttacgctgcttcagcagccggtggcccatttgaactgctgggcaccacagcaaccacaagctaccgtacagacgctccggttaacaccgcacgcttttaccgtgtgcgcgctctggacgcactgggtaacccgagtccgtacgctgctgttacaggtgacggtgtggaccgtacaccgccgaaatctccgacctcactgggtagcgttgtgcgcgttggctacaccgacgtgtactggaaacagccggacggtttttacgaagactttgacaacggtggcacataccgtgtttaccgctctccgggtaaaacactggacccggcagcactgacaccggtgacctgtgccgaaggtagtgacgaaacctctacaggtggcctgtgccacgacctggacatgcctgctggtacatacgttacatacgcagttgctgctgtggacccagcaggcaacgaaagtgccctgtctgcgccgctggttgtgcgtacaggtgaccgcgtggctccaggtccagttaccggcgtgacagctacaccgcgtgcagacggtattctgatgcgctggagcgcaagtaccgaagacgacgttgaacgttacgcggtttggacaggtgtgcgtcaggctgacggtaccgtgaaatggctgaccacagcgagttgtcgtgaaggcacatctgacccgctggctgttctgtgcggtgacctgccggacggcgaaacctacgtgtacgctgttgtggcacgcgacctgtggggtaacgcactgccgccgtcagacccgaaagttacagttgtggaagcgaccgaactggacgtgcgtccgtcagttacggttgctcgtgactgggacctgggcagcctgggtcacggcaccgttattggtggcccggacgaagacggtccgtctatttcatggcgttgtgaccgcacagccgaatgcgacaccgttgcgggttaccgtgtgagccgctggaacgcagccacccaggcatacgaaccactgcacgtgggcctgctgccagcacagacacgtgactacacagacaccacagctgctcgcggtgcagcacacttttacacactgcaggctgttcgtgctgacggtagtgtggcaggcacctacgtttggtcttgtgtgtttcaggaccgcgttcaccaccaccaccaccactaataa

SEQ ID NO: 624 - DNA, 2856 bp, Artificial Sequence; identical to SEQ ID NO: 608
  Optimized for Arabidopsis thaliana and Solanum lycopersicum

SEQ ID NO: 625 - DNA, 2304 bp, Artificial Sequence; identical to SEQ ID NO: 609
  Optimized for Arabidopsis thaliana and Solanum lycopersicum

SEQ ID NO: 626 - DNA, 2835 bp, Artificial Sequence; identical to SEQ ID NO: 612
  Optimized for Arabidopsis thaliana and Solanum lycopersicum

SEQ ID NO: 627 - DNA, 2436 bp, Artificial Sequence; identical to SEQ ID NO: 616
  Optimized for Arabidopsis thaliana and Solanum lycopersicum

SEQ ID NO: 628 - DNA, 3864 bp, Artificial Sequence; identical to SEQ ID NO: 620
  Optimized for Arabidopsis thaliana and Solanum lycopersicum

SEQ ID NO: 629 - DNA, 1110 bp, Artificial Sequence; identical to SEQ ID NO: 621
  Optimized for Arabidopsis thaliana and Solanum lycopersicum

SEQ ID NO: 630 - DNA, 2496 bp, Artificial Sequence
  Optimized for Glycine max
ccatggtttaggtctctctatctacatataaatacacaaaaaattccattatcaatggctccagcacctgctgcagctggtgctccacttgttgatggaggttcttaccaacttggatcagcattggatggatcttgtttgggtcctcaatatgctcagccagcacctggtacaccagttcttggagcagcttgcggtagacttttgtctcaaaggtggcagttgagaaggactggaggagattaccttttggtgaacgcagcttcaggaagatgtcttacattgggaggtcctgatcttaggccagctaccgcagattgcggttcagctcctgaggcagaaagattcactgtttctagggctccacaaggaacatataccttgactgtgagaggaactggtgcatgtcttacagctgatccagcacctgttaatcatcactgcgatcatagaccagctcacaggtggacattgaccaggactgagcctcttgtgttggcagatccaggttttgaacagtcttcaggatctggtgctcctactacaggagcaccaaccactggtgctcctacaaccggagcaccagcagctgattcttcatctgcagctgattcatcttcagctaccggaggtccttcaactgcagctggttggacattcaccgctcatactggaacagcaaccaacaatcctcacggaggttcaagacttgcttacttggatgcaggaccaggttatactgtttctcaacaggttactgctgtgacagcaggtacctacgatttgtcagcttggattgcaactggaggtgctggaggttcactttctgtttcagtgaacggaacagttgtgagatcacttccattgcctgagcaatctacatatgctaagtacaccttgccaagagttagggtggcagctggagataggcttactttgacaattggttcttcacctacaggatgggttaacgtggatgatgcagctgttgctccatctgcacctaatgatccagtgatttcttcatctgatccagaggttgtggctctttttgattgggctaagaccaaggcaaactcatgggttcaacagcctggagcaactggtgtgttggatcaagatgaaaatcatccaggaggtaccggtactacaacctatgatgcttcttactgggcaggatatccttttagatctgctttctactcaagggatttcgctcatcagcttgttggtgcacaccttttgggattggatgctgaaaataagactatgcttagaggttttgcagcttctgcaacagatgttaacaggctttatccagtgtgggctttgaatttcgatgcaagatcatacgcagctattgattataggggacctgatagatttgttagggagcttccagctcctttcgaattggtgcaacaggctggagaggcttttagatggaccggagatagggattacgctgaagatcctggattgggtagatatgttaggaacactcttggtccattcattgcagctagaccaggacctgttgataacggaggagttccaattcctcaagctacctctagatcaattttcgctggaactgcatcttacgctgagaacgcaaccaggacttatgctgaagcaggagatgctgtgggtgcacaatatcaggcttaccttgcagctgcaactttggctgaggcaagaggagatgctgcatcagctgcaggatacaggaaggctgcagatcagcttcatacatatgttaacactacatggtctgtggatggatcaagacctggagaggttgtgcacggttacgataccactggaaagccaattactggatggggttatgaagcttctgttcttatgcctgtgaagagacttttggatcctggtcctagaagggatggatttttggctgcagttgatgctgcagattcaggtccagagaggtctgctaaccttgaagcatatacctacttgcctgatgctttctttgcaaatcatgatggtacaaccgcttggaagtggatgaggcatatctatgagtcaactggagaaccacacgtttctggtgctatgttgaacggagattatcctgaggtgccattcactcttttggcacaaacagttcagggacttttgggtgtgacaccagatgctgcaggacacgctcttactacagcacctcaattgccatcatctatgggttggcttcaggttgctggaattcctgtgggagcaggtacagttaccgtgagacatgatggtgctcaaaggtctactgttacaaataccggaactgagagattgacatgggaagctaggttccctggtcagcacgcaagagttaccgtggatggtgctccaagagaagcaaggaccactacagttgatggtgtgacatatacctcaaccactgttactcttgctcctggaaggtctgctactgcaacagtgaccgatcatcaccatcaccatcactgataagagctc

SEQ ID NO: 631 - DNA, 2502 bp, Artificial Sequence
  Optimized for Glycine max
ccatggtttaggtctctctatctacatataaatacacaaaaaattccattatcaatggttcattttaagaattgtccagatccttcacttaacgcaaattctcaatcacatccagagttttcttcagagttggaacacattaaggctagaatgcaaaacttcattaagcactctgtgacagatcagaacattgaagtgaccgatgctagggttactgcagagggagaaattacctcacttttgaaggagagacttgataaggaatacttcaagcttttgtctaagattactagggaggttaatgtggaagattttggagcagttccagatggtagagataacacagaggctttcaggaaggcaattggtaacggaagagttaaggtgaacgttccagctggtgaatatcttgtgcaaggaattaagttgccttcttggactacaattgtgggtcagggaaagggtattactgttattaagttgcatgaggatacacctgcacacgaatgggttattaccaacgatgattaccaaaacggaaataggaacatttttgttcagggaatgtcacttgattggaatccatctagacaatgtggagtgaggaaccctggaggtcagttttcttcatgcttgactttcgctaaggtggagtatggttggattaaggatgttgaagctattaatgcaggacttcatggtattgatattacatcaccaacctacgatcacttgcctgatactgattggacaaaggatggatctagatacatctggatcgataactgtgttacatacggatcaggagatgatggtatcaccactcattactctgagtacattttcatttctaactgccactcaggaaacccaaggggtaccgagttcgtggaaggtgtttctaattcaaacggaattgaagtggatgatggttcaagacatgtttggcttttgaacaatttcacttctggaaacatcaggggtgtggaggttaaggcacacgaactttggccagcttcacaaaacgttcatattattggacacgtgtcttatagagatgttagggctttcgatcttagacatattggtcatcaccagattactgatcctgagtctacaaccgcatacgatgtgacattgattgattgctcagctatcgaaccagtttttaattctctttacgatgctgtgacccctagggcattggttatttcagcttacaagaatgtgaacgtttctggattcactgcaattggagatccagattatgattacaagggaaaccctgttgtggctcttcaatacaggtcacagaacatcacaattaacggaattaagatcagaggttttaagaaggcaggagttgatattaatttgtctggaggttcaaacaagaccgattatattaagatctctaacttcgatatctataagtcagctcctaagggaatttctattggaggtggactttacaatgtgaacattttgaatggtaccatgattactgataacggaaccgttggtattcaatctccaaacaatcaggctactattttgggtgtgcaatctgagggatattcagttgctgcatctattaagggtcagacttaccaacagattcctattaatcttaagggtggaattcaattggcaactacatcaggattcgctgtgaaccagacatctgctgttattgcaggaacaggagatattaccgcaagaggtgagaggaatgctgttatttcttcatctggtggatcatctacagaaggatcaagagctttgattgcatcatctaacaatgcacatattaagggtaatcacgtgtctaggaccatcctttcatctgaaaacatcatcttggaggaaccatatactgtggctggtggacatcaatctatgaagtggcttttggattctgttagaggaaacggtacctttgctggagcaatttcatcttcattgggtggatatggagagtacttcgaatcttcaacaggacagcttattcacaccggtactattgttaccttgaggggagagaagattgctcctgcagatgtgggagattacatgcttggagttatttctgaaacttcagcttttatttctggagcttcttcattcgtttggcaaggtagatatttgactaacgagtttggaggattcatctatgaagttgtgacagatgaggaatcaggagagcttattagggtgccaaagcagaatcctgattatgatacagctttggaggcaaactaccattctagagctgcaagggatgaatggcatgttgtgggacttgtgggaaagcactatgttagaattgatgaaaccgtttcacaaggaaattacttgacagctcacaacggaattggtaccaaggctgcagagggttcttggaaggttatgaagattacttcagcatatacatctgaaaagggatacggtattgctcttactgtgattaagcatcaccatcaccatcactgataagagctc

SEQ ID NO: 632 - protein, 950 aa, Artificial Sequence; identical to SEQ ID NO: 564
  Optimized for Arabidopsis thaliana and Solanum lycopersicum

SEQ ID NO: 633 - protein, 766 aa, Artificial Sequence; identical to SEQ ID NO: 563
  Optimized for Arabidopsis thaliana and Solanum lycopersicum

SEQ ID NO: 634 - protein, 1396 aa, Artificial Sequence; identical to SEQ ID NO: 590
  Optimized for Arabidopsis thaliana

SEQ ID NO: 635 - protein, 169 aa, Artificial Sequence; identical to SEQ ID NO: 573
  Optimized for Arabidopsis thaliana

SEQ ID NO: 636 - protein, 943 aa, Artificial Sequence; identical to SEQ ID NO: 560
  Optimized for Arabidopsis thaliana and Solanum lycopersicum

SEQ ID NO: 637 - protein, 661 aa, Artificial Sequence; identical to SEQ ID NO: 593
  Optimized for Arabidopsis thaliana and Solanum lycopersicum

SEQ ID NO: 638 - protein, 602 aa, Artificial Sequence
  Optimized for Arabidopsis thaliana
MQDISGSQGSTTNEFNPWSPQNGHPYRHGAVPGMSQHENYKKWLAAHNQAAATGQQTLSYGGGVDGIGVQSGHSKVYLVFYGNQWGTQTTDAGGNAKFSNDSAGAAGATQQMFKGIGTNGETWSADLTQWCDGPNVATGAVSCPSNANFIPYQSGGVLSGVWYDNAAASPSQASGNQLAQEAVKAAGHFGNTTAAANRDAYYIVLSPHGTNPDDYQNPTTGYCAWHDWNGDTTLTGGAASSPYGDIAFSNQPYNIDAGSNCGVGFVNSPGTLDGWTMTLGHEWHEMMSDQNPAGGWTNHVSGSSYNGQENSDECAWIQPGSTGGAANISFGAFGSYAEQASWSNDTNSCAISHAILTHGNAVTVTSPGNQSGTVGTAVSLQINATDSATGQTLGYSATGLPAGLSINASTGLISGTPTAAGTSSVTVTATDTTGAAGSTTFTWTESTGGGGGNAITNGGLETGSLTGWTTVGSTSATAPAAHSGGYGAMVGSTGPTGDSSIAQTFTAPTGTSKLSFWYSNTCDDTVTYDWATATLKDNTTGTTTTVLAKTCTTTGTWTNKTATVTPGHSYTLTLSNHDDNYPGDPTYTYYDDVTVSHHHHHH

SEQ ID NO: 639 - protein, 799 aa, Artificial Sequence; identical to SEQ ID NO: 576
  Optimized for Arabidopsis thaliana

SEQ ID NO: 640 - protein, 810 aa, Artificial Sequence; identical to SEQ ID NO: 589
  Optimized for Arabidopsis thaliana and Solanum lycopersicum

SEQ ID NO: 641 - protein, 707 aa, Artificial Sequence; identical to SEQ ID NO: 554
  Optimized for Arabidopsis thaliana

SEQ ID NO: 642 - protein, 226 aa, Artificial Sequence
  Optimized for Arabidopsis thaliana
MKEKETARYAKEIADLQQGTTPQDVLQSAKELAKQKHVSTEAILKQFHQEITADKVQGNVIVSKEGLSAMGGSSGTKKLPKSTKGNIYYTNSYTAYYNHGHVGMYSSADKIVESVPGDGVRQIAYNGREVEDNSIVQTVKVTDAQKQAAADWAVSRVGDEYSFNFVNNRNTGHEGAKNCSKLLWSAFLLKAGIDIDSNGGLGVYPRDITSSSYTTTILTIHHHHHH

SEQ ID NO: 643 - protein, 335 aa, Artificial Sequence; identical to SEQ ID NO: 566
  Optimized for Arabidopsis thaliana and Solanum lycopersicum

SEQ ID NO: 644 - protein, 1286 aa, Artificial Sequence
  Optimized for Arabidopsis thaliana and Solanum lycopersicum
MAPSPTSGASSSTPSSGPPSAPPSAPPQAPPSEAKRAAERAAEPAGPEQTPAAAAAAAAPAVSDAVYAYDAAGRLVGSTDPAGETARYRYDEAGNRLGIDRFASADLSVLSLVPTRAAVGATVTLSGTGFSTTPSSNAVSFGGQTAEVVSASATRLKVKVPAAAVAGKVSVTTGGGTAQSPESFTLAAPAPSVTKVDPTSGYAGTAVVLSGAGFAAATADNVVRFGGGVVAEIVERTDTALKVLVPAGAATGPVEVATPDGRTTSAAAFRLVAGDGGGEIETSVETSVTDETPPTVSVTTPGNQAQVVFDANAGDDISIGFTESTFNQTVTVRLLDPQGKRLESAAYTGTAGDWEMTDVPVSGQYSVIVDPGTGNIGSVKVTVSNPRISALDLAGPAVDAQFTRPGQDHLLTFAALLGDSLSLGIDATGLAKSTYARLYGPDGAEIDKVYVTGTRIGGLDVDALTQSGTYTLQLDPDAAALGTVKVTGSHYADAGTLTATGPALDVSLIRQGQQGRAQFSAQAGQRVSLGGSATGFGNFTRVEIHQPDGALLDYFLVPDADAGQWDSATLTTSGTYTVVVKPGSPLATGKMTLTLSRPLALAALTTTASASAVNITRPGQNAESSFQAQAGADLSLGFTANTFPQYIDVTVTAPSGAKVVDGVNVTAGAATTIPLPVLTEAGTYQVVLDPNKGAVGATSLTLSAVARATLTADGAQQPTTVARAGQRVRATFTAPDTAALGLAVTANTIAESTEIRLIGPDGGAGALAGRVASKASDTFYLTGLTSGTAYQLVFEPAKATTGAMTLWLSKPVKAGTLSTTAPTLTGEITRPGAQLEFGVTAVTGYGAAVVFSGTTLTETSALIHQTPGGVEDNVGSLSKATLDADLRAPLAVGGHRVFVRPNGSATGKTTATLVPNVTGGALATTGTKKSVAIATAGQNAHYTFTGTAGQKLTLGLDTPPGAWSLSVHGPDGKWLVDGRNMSATTVSYALPALPANGTYTLSVDPNSLKTGTWNLGLTAAATLRAATAADTADGPDTAEGADKAAGADEPATPKPPAAGVTPTGADAWQPDKGNLSGHDWLTRRGDAPKAPPTLRAPPKTTALTGHVLKLDGKPLAGVTVSAGANTARTDAEGRFLLAGISPEATTLVVDGASANTKQRQYGRFDIRIRPKADTSVDLGFPVWMTPLDMKNTVRFAAPAKTDVVLKTPKIPGLEVRIPKGSVVRDEKGRPVTELGITAIPIDRPPFPLPENGVVPVFFTVQPGGTYVFPEGADRLPELHAHHHHHH

SEQ ID NO: 645 - protein, 368 aa, Artificial Sequence; identical to SEQ ID NO: 585
  Optimized for Arabidopsis thaliana and Solanum lycopersicum

SEQ ID NO: 646 - protein, 812 aa, Artificial Sequence; identical to SEQ ID NO: 578
  Optimized for Arabidopsis thaliana and Solanum lycopersicum

SEQ ID NO: 647 - protein, 683 aa, Artificial Sequence
  Optimized for Arabidopsis thaliana and Solanum lycopersicum
MKYLLPTAAAGLLLLAAQPAMAMAVTCASPVWRAQYFGNTTFSGTPKLTACDAAVNENYGYGDPTGVTLPKDNFSVRWSLTRDFGSGGPFRLSAATQDGMRVYVDGVRKISLWQNVSTTARKTVDLTIPAGKHTIRVDYVAWTGLAHAAFTYAPRTEAAVDTVKPLAPTGLTAAYNRDTAKTTLRWAANKEMDLAGYRVYRRLGTTQWARAGGSSLLTSPSFVDATPATGQTFLYEVRAVDKAGRESVGSLDATAVTVDRTGPAAPTGLTVTGDAWWATLAWQGAADAATYEVYAASAAGGPFELLGTTATTSYRTDAPVNTARFYRVRALDALGNPSPYAAVTGDGVDRTPPKSPTSLGSVVRVGYTDVYWKQPDGFYEDFDNGGTYRVYRSPGKTLDPAALTPVTCAEGSDETSTGGLCHDLDMPAGTYVTYAVAAVDPAGNESALSAPLVVRTGDRVAPGPVTGVTATPRADGILMRWSASTEDDVERYAVWTGVRQADGTVKWLTTASCREGTSDPLAVLCGDLPDGETYVYAVVARDLWGNALPPSDPKVTVVEATELDVRPSVTVARDWDLGSLGHGTVIGGPDEDGPSISWRCDRTAECDTVAGYRVSRWNAATQAYEPLHVGLLPAQTRDYTDTTAARGAAHFYTLQAVRADGSVAGTYVWSCVFQDRVHHHHHH

SEQ ID NO: 648 - protein, 950 aa, Artificial Sequence; identical to SEQ ID NO: 564
  Optimized for Arabidopsis thaliana and Solanum lycopersicum

SEQ ID NO: 649 - protein, 766 aa, Artificial Sequence; identical to SEQ ID NO: 563
  Optimized for Arabidopsis thaliana and Solanum lycopersicum

SEQ ID NO: 650 - protein, 943 aa, Artificial Sequence; identical to SEQ ID NO: 560
  Optimized for Arabidopsis thaliana and Solanum lycopersicum

SEQ ID NO: 651 - protein, 810 aa, Artificial Sequence; identical to SEQ ID NO: 589
  Optimized for Arabidopsis thaliana and Solanum lycopersicum

SEQ ID NO: 652 - protein, 1286 aa, Artificial Sequence; identical to SEQ ID NO: 644
  Optimized for Arabidopsis thaliana and Solanum lycopersicum

SEQ ID NO: 653 - protein, 368 aa, Artificial Sequence; identical to SEQ ID NO: 585
  Optimized for Arabidopsis thaliana and Solanum lycopersicum

SEQ ID NO: 654 - protein, 810 aa, Artificial Sequence; identical to SEQ ID NO: 589
  Optimized for Glycine max

SEQ ID NO: 655 - protein, 812 aa, Artificial Sequence; identical to SEQ ID NO: 578
  Optimized for Glycine max

SEQ ID NO: 656 - protein, 237 aa, Streptomyces Sp.
  Derived Active Sequence
APAAATEPAPFSCLDPSGEALWSGPQCDGVIVRELGTEAVAILLDGRRIDFADEAELRADDCAVRPAVTLPASTFENLPKGPDPLYAAVDRRVDVPRIIPEPQWRKNCHPLFRSDGRDPSVIFEEGFGPKDTVNGQYDITSYVLQNQPSPFVSTTYDPELYKKWKKVPWDYFIDAPGGIDVNATIGDQHQYADQVEVAFPGGVDRHFIRRACPVDRATASLVEAGCVDNPNYQPWLH

SEQ ID NO: 657 - protein, 2454 aa, Streptomyces Sp.
  Derived Active Sequence
LIAAVVQVPVIAAAADGEFKLPSVQHIESVPLSRVTGDRPDTGAAQPPTAPPASAWPKPGKTEIDLPAVSAQQPSSQAKAPGLPLTVSSVGPTPAAGEPSKVRVGLSDRAAAATVGLDGLLVNLEPVAGSAAPDKARVQLDYKAFRESFGADWGSRLTFVQLPACALTTPDQPQCRSATPLAASNDTKAGTLTAEVAVSAPAGQVSADGQASSGGTVKASFTQASEASAAAATVLAATAGASGPEGDYKATSLSPSSTWSVTGNTGSFTWSYPIQVPPVPGGMAPKIALGYTSAAIDGRTASTNNQSSWIGDGWDYNPGFIERNYTPCVGDTGPGSNAPATSGDLCWKSDNATISLNGNASALVRDDASGTWKLSNDDGSRVEKLNGNTTDTANGDTDNEYWKVTTTDGTQYLFGKNRLPGWTTGKPETGSALTVPVFGNQPGEPGYAPAFKDSSRDRAWRWQLDYVVDPHGNAIAYFYGQEKNAYAKNIGAATGTPKADALYTRAVTLNRIEYGHRAGQVYNTPPAGKVTFSTADRCVAADCSFTKANAGNWYDTPVDQSCDKDQDCRNGAPTFWSKKRVTGISTQALQSNGSYRDIDAWSLDQDFPATGDSGGRALWLKTITRTAKAGAAAQTLQPVTFGGDLRPNRVDSAEGRPPMNRYRVNRITSETGSNTDIKYTDIDCVAGALPAPDSNTRRCYPSWWTPEGAVDPVLDWFHKYLVDTVTEHDMVAGSGSPDKVTGYEYLDGAAWRRDNSEFTPDKERTWNDFRGYQRVRTRVGASDKSLAETVYFRGMDGDTLANGQPRPASPLQGVKDSNELAGYVRESTVYDKDGGKPLTSTASTPWVRGTASRATKALPSQDGKPTATPPGESGRPQVAALPPLTAAMVRTESETTKAFQPDGGTARTTRLSRTFDDYGQIRTVSDEGDTNISGDEQCTRTAYVTQDTANWLIAYPQSVQITSTLCSTNATAATVTSETRTAYDGRPVGTAPEPGKGYATTVQALDRYDGATPHYLTATTTAYDQYGRVISVKGANNAETTTSYTPAGGSQPTLVQSTNAKKFTTTTAYDGLRALPVKVIDANNRTIHVDYDAMGRTTAVWNAGRDKSASPSATYTYTIEPGRQPAVTTRTLLEGGDYHTSIALYDGLLRPRQVQDEAHGGSTAHNGGRNITDSFYDSHGRAYRANAAYHADGAPEAALWIGLDNKVPSQTETEFDGLDRPTASIFKSLNVEKWRTVTRYGLNWVATTPPDAGTSTLTVADAHGRPSEVRHYKTGSPDYDAPASAYETLKYTYDSAGKLAKLVDPAGNAWTWEYDLLGRQTKTVDPDKGTTTSAYNADGTLATVTDARGRTLAYTYDVLGRRTGMFDGSTSGTKLAEWAFDSLPGSNGLATGSTRFENGKAYITGITGFDGAARPTGTTVTIPDSEGLLAGTYTAAQTYTPNTGLVDNTTYPAGGGLPQETVRRNYTPLGLPTTVSGGSRVYSLGNTYSPLGQLQQSVTGDIGSRAVQTYDYENATQRLAVVQTDRERSGPQTLEKKTYTYNPVGNITRVRDARDNAAVTDTQCYTYDFAQRLTNAWSATDDCVAKPTPTTDPYVGGVDPYWTSYTYDAAGNRTQATDRTFGAAPGPLMDTTKVTSVAIAGDGQTTAVAIADGQVHIAQQRTDGTWANFENLHRTQAGSLPAPVDYVAAAWADNTLQIMAVAGGRIWHTLRGADGRWGAWGDVTSVVGSIANPSQLSLSATASGLEVLALSDGVLKHTLRKPDGNWSTWGNVYGETGSLTGATRVTSAATGTGLEVIVTAGDKLWHTVRFPGGTWQKWGDVYSATGTLGSPTGITATATGAGLEVAAIVGGSIWHTVRKPDGNWSTWGNVSQVLGRLDQPTSAAVVSSGGDLKLITIAAGSLNYTKRAYATGSWLPWAQLTQTPENPPSDQIQRTSTYPAPGGTRPHALSRVDITGIGARTDTFTYDEAGNTVRRVTADGDQTLDWDIEGHLAKSTTAGKSTTFLYDANGNRLLRREPDAVTLYLDGQELKLDRAANKVTGTRYITAGPVTIVKASDGSLNYLINDQQGSAQLAISADNLDYTRGDTTPFGTPRGRKPASWPTERGFVGGTNDATTGLTHLGARDYDAANGRFISVDPVLDPTDPQQINGYTYSNNNPVNLSDPSGLRPEGTCGGFGACQTPTGEKVQEVWTSDHGVWTDTITKTRPPYQPPAQNTSSGIPGLKKPAPQTAQPDDACGSKAVCAMADKVDDAMRLCAEIGCGVYSVTNYPRNNDSSHDVLRAWLLNAWDNPDVVNFGAGDPLLMDLAKTDEVQVLMEMLLTNYKEKGAKAIGEPLRNQYEDNGPLGTAWLGIPADVLGSLTNGAIGADEAKAVIGSFVVHGTIDSVQSARDGYQVVNMHFTVVNNWNWNSATKMLPADWYPTIPTASGVGWTPGKPIDGHFEWGFRSFVGPSGG

SEQ ID NO: 658 - protein, 700 aa, Streptomyces Sp.
  Derived Active Sequence
ARAAGPATVPEQESIEAQIARAAASGKKQVDIEPGEYRRGSVLDLSGLDGFTINAKGVTVVQTRLVQAVRTGTSNNLTVTGLTINYDPLPFTQGRVIGLGKTSDGKPWMDVRIDAGYPRPDKIPSRVSVYDPALRLWRSQAYNIPVTWQDRTAGVVRSMGGAWAAGTGDIVAFAGEAESGPDIAIGVGGANNTFKDVTLHTAPGFGFQNRAGEGNTHLDNFRVVPGPPPPGGTEKPILTTTWDAMGFGWVKKGPTVENSTVVGAGDDSMSVQGFGTAKVLKADGDTLWAAFADGFRNALPGDRLQQWTDGPTASIRSIAPEKDPAIKALAGAKADFTYKLTLDRPSPWNAGTDITNLDRIGSGFVFRNNRIDSSGRGFLVKARDGVIENNWMRGVNSISVTPENTSDANANSGGNLVIRGNTFTGTLVSAPGGWDSCQVGAVSFDPGSASRPLYPDITIEDNVFQDIRGTGLNLGSAKNVTVRNNFFQRSHQATYPATKNRCGIPKSSVVYVSNSTGVTFEGNTIDRIGPYSVQQVTVDDRKPSGISGLPGGVKVLNPYLPVKAASTYTISNRDSRLLLAPAGGSTDAGAGVEQQSAADGSAQRWRLSPAGNNNTVRIQNAVSGLFLTGGSDSAVTQQPRSDDQSQRWRLLDTGNGTAKISNVATGKVLGATDSAPGAPAGQWPVSGALDQAWKFTDVSP

SEQ ID NO: 659 - protein, 697 aa, Streptomyces Sp.
  Derived Active Sequence
ETATAGQDSGALSARVAPTQEDIQLGSWMSQLGSTIGDRPLNQIVMPGSHDAGSAGITKNSGMCDAGDTVDTARKWPELASSMSRTQSGSLVEQLEAGSRYLDLRLCKQGDKWYSYHGGPLGRQFFDSLGGNQGIVPGEARELADWINRHPKEIVILRVKTTGPAATLKEDSRAAIARLGGLVGGGGLDNPAIADGSLKPTSTYNEFMAAGKHVVVVDDTDSTTYPWAWQQPNVQDYRGSYVGVSSKWDDILKAALDPALEQKTYDAVLRRGDEVLGKTPEPGSEKKLFVQQAMIDPSNSIPSAAVIQILEKLKLVSEWKADNFLISMENELNRQLLAKLRTSWNNTNVTDNMNIVMTDDVNQNRNGVAAGELQREIISKNLPQRITSHTFYNSTRKADGTWTGPSALSGAGTAFRYVGDRQAVGATRDGGVQVLGVGADGNIWHNLRRPDGSWQGWNALLAADNKNVGFAAKDIALTTMPNGDAQVVAVGKDGYAYHNIRSADGGWQGWASMPGHDAGLLKATKVAAAGMPDGSTQVLVFGGDGRMRLGTRAADGAWSSWKTVAGVNAPDFAGSALSIAALPNGDSQIAAIGNDGNVWHTTHRADGSWSDWGLPAGVSGGAMEASAVSLAGMPGGSVQVAAVGRDGNVYHGVRSSGGDWTPFQRVSGIKGAGAFAGDQVGIAGLPNGSSQLILTTR

SEQ ID NO: 660 - protein, 1279 aa, Streptomyces Sp.
  Derived Active Sequence
APSPTSGASSSTPSSGPPSAPPSAPPQAPPSEAKRAAERAAEPAGPEQTPAAAAAAAAPAVSDAVYAYDAAGRLVGSTDPAGETARYRYDEAGNRLGIDRFASADLSVLSLVPTRAAVGATVTLSGTGFSTTPSSNAVSFGGQTAEVVSASATRLKVKVPAAAVAGKVSVTTGGGTAQSPESFTLAAPAPSVTKVDPTSGYAGTAVVLSGAGFAAATADNVVRFGGGVVAEIVERTDTALKVLVPAGAATGPVEVATPDGRTTSAAAFRLVAGDGGGEIETSVETSVTDETPPTVSVTTPGNQAQVVFDANAGDDISIGFTESTFNQTVTVRLLDPQGKRLESAAYTGTAGDWEMTDVPVSGQYSVIVDPGTGNIGSVKVTVSNPRISALDLAGPAVDAQFTRPGQDHLLTFAALLGDSLSLGIDATGLAKSTYARLYGPDGAEIDKVYVTGTRIGGLDVDALTQSGTYTLQLDPDAAALGTVKVTGSHYADAGTLTATGPALDVSLIRQGQQGRAQFSAQAGQRVSLGGSATGFGNFTRVEIHQPDGALLDYFLVPDADAGQWDSATLTTSGTYTVVVKPGSPLATGKMTLTLSRPLALAALTTTASASAVNITRPGQNAESSFQAQAGADLSLGFTANTFPQYIDVTVTAPSGAKVVDGVNVTAGAATTIPLPVLTEAGTYQVVLDPNKGAVGATSLTLSAVARATLTADGAQQPTTVARAGQRVRATFTAPDTAALGLAVTANTIAESTEIRLIGPDGGAGALAGRVASKASDTFYLTGLTSGTAYQLVFEPAKATTGAMTLWLSKPVKAGTLSTTAPTLTGEITRPGAQLEFGVNAVTGYGAAVVFSGTTLTETSALIHQTPGGVEDNVGSLSKATLDADLRAPLAVGGHRVFVRPNGSATGKTTATLVPNVTGGALATTGTKKSVAIATAGQNAHYTFTGTAGQKLTLGLDTPPGAWSLSVHGPDGKWLVDGRNMSATTVSYALPALPANGTYTLSVDPNSLKTGTWNLGLTAAATLRAATAADTADGPDTAEGADKAAGADEPATPKPPAAGVTPTGADAWQPDKGNLSGHDWLTRRGDAPKAPPTLRAPPKTTALTGHVLKLDGKPLAGVTVSAGANTARTDAEGRFLLAGISPEATTLVVDGASANTKQRQYGRFDIRIRPKADTSVDLGFPVWMTPLDMKNTVRFAAPAKTDVVLKTPKIPGLEVRIPKGSVVRDEKGRPVTELGITAIPIDRPPFPLPENGVVPVFFTVQPGGTYVFPEGADRLPELHA

SEQ ID NO: 661 - protein, 936 aa, Stenotrophomonas Sp.
  Derived Active Sequence
AADDVMAMSYHVQGDRIFLSGGVTYADVVSLPALLAKAQAEGRPIREVVLRTSNGGALIAGEWLQGVIRTSGLNTIVSGHCISSCSIMQSGGVERYLAGDLPIVDSVQIHAASNSGKVIYTPSPRMTQIYTGNYGGGIDAGLLHKAMYEVVQPNGLLVFRDPARTTGASVTFDPDGSGSKLESFPGQDIYSNRVITAKGYRDPGDTLNVTANVSGDINPGYLRTGRQLQTFVDDDFARWNTNWQSSYINLAQSIYNASSNGPQGIGANSVQDYQNDPTYKALLLSKLRLGDLDVSTLDNSMGVIRVTNGATWRTSATTGADFMLVDNGTIALEGGALRASEVRVMAAGMLVGNGDVAGTAMDLSALASGTRPSWREDGFNRLRVYGTLMPRGGDLVTHGYVNIMPGGKVLFDVTENGGAGSGRLRVGSFFDSKQTDGALVISKGAFLELNVAQGYYGQDFRRDLVQGPIYQGGFEEVVRLGDTGYSASITGGEVFRPRHNSLLSFNVKQAADGLWLTANPGFDQLGLFTNRTSGDGLGRALATASDRRDGGLKSLLGALQFADRDVIAQQAGALRGDAHATLRLADNALVGSIGNVVQQHQAAMRSGGDADGLASQAAQSVSAQPGMRHGSLFNQLAMHLVEPAAGGGEGSGPGRNHGLWARGFASHGRIDADGGVAGLSHNIGGIVVGADTRVADDRVTLGVSVAAADMSTKGRDGSDFSGDVRALDVGGYLDATYSRGYLSAAVRYTDLRHDTRRSVSGIDGLQQPLRAKYSNDAISARVEHAFSFTTGKGLVIQPLLPVVDYARTSATRFNEGQGAGALVGRSGSLESIRVGAGLQLFRTFEGNNGERITPRARVVWQKELGDSQARYSTGFAAAPDLVFGASSQAVGEQVLAWNLGVTSRASERLSIMADYVGERRDGQIQNGVMLGLGYKF

SEQ ID NO: 662 - protein, 653 aa, Streptomyces Sp.
  Derived Active Sequence
SPSDAAEEAGHLVGRGIADVTGEAAETGMMGYSSFDQKTSGIHQRQRSRAFVVVDRSSGKRVVYVNADLGMIFQSVRQGVMARLKERYGSLYGEENVLLSATHTHSGPGGYSHNVAYNLSVLGFQKETYRAIVDGITESVAKAHDDLKPGTMSLGTGTLTNASVNRSREAFDRNPAADRSAFPDGIDPAMTVLRFRQGGKDAGAISWFATHNTSITNKNTLISPDNKGYASYVWEHDHEGVRYLDDTPGFVAAFPNTNAGDMSPNLNLKPGSGPTEDEFENARVIGERQLDKAREVYDDARPVTGGVDSRIAYVDMENVTVRPEYTPDGKEHRTCPAVVGASTLAGSVEDGPAIPLFEEGMRTPVATVLEALRVDTPSWLATCQYPKASLIPTGLLSNVHPVTPKRLPLQIMKIGELHLVAAPGEFTITSGLRVRRTVAERLGVPLDRVLLQGYANAYSQYVTTPEEYDTQNYEGGSTLYGRYTLPAYQQEYARIADSLRAGTALERGTMPADESGRQFTFQTGVVYDNPPSGKAFGAVLKAPESSYARGSTATAEFATGHPKNNVRRGSTFLEVQRLENGTWQRVLDDGDGETVYRWTRINGLTGTSKATITWRIAADTAPGTYRIVHHGDAKNLLGRITPFSGATGAFTVK

SEQ ID NO: 663 - protein, 685 aa, Streptomyces Sp.
  Derived Active Sequence
LEPAALNGAVTAAADGVDGSGTQAGLVGYDGAPGETGTAEGATQVPAPKRDQKAAPLKAIPKDEPERGLVYAGLSLPGSDRCGGTLEVTGSTQCSHGPDVPPKGVDIRQDVPPVAAPVARTPALTPAAGAQAPAAADLLKGSAPVLDATQKALLGGAGTAADAARAGADAPAGSKLVCEGDGSSGNRVQVVYVHSPGNDRFAQYLASFKKWAADVDVIYNASAAETGGERHVRFVTESDCSASVLNVQISDAEIQDFNASNRALAAQGFNRKDRKYMMFTDAKVYCGIGTFAGDERPGQDNLSNFGPSYGRTDSGCWSGSTAAHELGHNLGAVNNSVPNSSKAGHCVDEWDVMCYSDAPDYPQMRTVCPDRAHDDRLDCNHDDYYNTSPSPGSYLTTHWNVANNRFLVAGGGSGPDPTPTPTPTGTPTRTPSPSPTPTGSTTPTPTGSPSPTATPTATPTATPTPTATPTAGNTGPAVAVSQVTQNSAVLSWTAAPAAAGYDVLLNGQAIGTVRSTVVGVVRLAPGTSYTVAVAVRDAAGAVGKPGRTATFRTVTDTGRPQPGTRYTMVNGLTGQAADLWGSSMNDGTVAIAYQRTGYANQKWQFEDAGNGAVRIKSARSGKCLQLGGAPVAGQYVAQQPCSDTAAQKWQLNAVEGGFTVTADGGSLVLGLSTRWYYGGWLLELQ

SEQ ID NO: 664 - protein, 758 aa, Bacillus Sp.
  Derived Active Sequence
KNNDVPFYNGQNDSFLTSLNLQLPGKYYRPGSGYAAKESLYRADVHFPAVYNGSFNWDNPRENLVQAEDTSEPYIRIANEGYLNSKVPAGDRMVTEVERVNNSVISSKYWGNPEFVLENMDKHMIQTYESFRELGQFYWIRDIAYLSGGYAGASGVGNINKYSLWYVRTSKPQVKDFQAMSGKKDIPVKFTFKGFEYVSKNKGYNDRDPNGTTVNPYQKAAGERNRVKWMLDITKDGETVYHQENYLRSTPQKDNQKPNEGDAGQFKKEDITWQPQLCGQYTAKIKVLDAVQRESNEKAVDFTIDGNCGTEVTPNPDPGDEDDFKYKIDFSADRIEGETAREGKNIKTRVDVSRDNFKLERDQYRAKVNNNINKSQQEINSTESDRDSAQSSLSYCRRNPIHEVDAEGKDHYYDRDCSWEENKLDSAASKLDNARQKLEKEKNKIKKLDVLEEKYMNPETVVVLKHNGQQVALQKVRLTEGEKKTLNLDWQHKGKGTIQAEINPAGNRIDIEETTYKNNPIKTAIYEPSKEKAMCGVTSVKGVVETVSERVSKEDITGAMYYETLTGSIGNLAPSKLHSGYGFSYEVNGKYKNDWNANYPGVFTAAKAQYPFADEGLKSTQDLEKKELKDTTAKFLPKNMYLSEATGHVFDSKRPTKSLYWDGQEKIIDGGQKWYSPLKTKNGVYTFNVETAPAGINEMSLCLTEQVEIKGVAYDDFIKRRVFPDDPFPGGSGVGWNWVGKEDVLYKLTDWYYMRNRK

SEQ ID NO: 665 - protein, 943 aa, Bacillus Sp.
  Derived Active Sequence
EDTKGEQVSYRNVLKMEPVGVQLPVQELAHSSKVLESKSFEKRLQFADLSQRPPEVKKESKQLAVAKTYTIAELNQLSNQQLVDLLVTIDWEQITGLFQFNTDSLAFYQNDSRMQTIIDKLKQQGQAYTKDDSKGIETLVEVLRSGFYLGFYNSELSKLNERSYHDKCLPALKAMANNSNFKLGTLEQNRVVSSYGKLIGNASSDVETITSAAKIFKQYNDNFSTLVDNLSAGNAIYDIMQGVDYDIQSYLYDTRKAPKDTVWYQKIDSYINELSRFALMGTITAKNGWLINNGIYYTGRLGMFHSTGTKGLQVVTDAMKMYPYLGEQYFVAAEQIATNYGGKDANGKVVNLDQIREDGKKKYLPKTYTFDDGAIVLKAGDKVTEEKVKRLYWAAKEVKAQFHRTVESDQPLEKGNPDDVLTMVIYNSPAEYQFNRQLYGYETNNGGLYIEGTGTFFTYERTPEESIYSLEELFRHEFTHYLQGRYEVPGLWGQGKIYENERLSWFEEGNAEFFAGATRTDNVVPRKSIIGGLSSNPAERYTAERTLNAKYGTWDFYNYSFALQSYMYNKRYDMFDKIHDLIRKNDVTAYDAYRSTLSKDANLNKEYQDYMQMLVDNREKYNVPLVSDDYLANHASKPVSDIAAEITAEAKLKNVSVKKNKPQFFNTFTLQGTYTGTAAKGEYEDWKTITQNVNDTLKRLSAKEWTGYKTVTAYFVNYRVNTSGQFEYDVVFHGINTEEGAENKAPVAVINGPYSGNVNEAISFTSDGSKDEDGKITSYKWEFGDGAVSNEQNPTHVYTKEGTYTTKLTVTDDKGATNTATATVTVQKKEDNSVEKEPNNSFQTANKLQLNQVLRASLGNGDTSDFFEINVETAKNLQINVTNENNIGMNWVLYSEADLNNYVTYAQQQGNKLVGSYYTYPGKYYLHVYQYGGGTGNYTVEVK

SEQ ID NO: 666 - protein, 179 aa, Bacillus Sp.
  Derived Active Sequence
HGYIKEPVSRAYMGALEKQTLGWTAAAQKYGSVIDNPQSVEGPKGFPAAGPPDGRIASANGGSGQIDFGLDKQTADYWVKQNIRGGFNTFTWYYTAPHATSKWHYYITKKNWNPNKPLSRDEFELIGTVNHDGSKADTNLTHKIFVPTDRSGYHVILGVWDVADTSNAFYNVIDVNLTQ

SEQ ID NO: 667 - protein, 143 aa, Bacillus Sp.
  Derived Active Sequence
ANLSRAGSLKGVNLFNGSWTVAIQAANLQYVSAEPSGNVVANRNAVNEWEKFELIPTGELYTFALKAKSNGKYVSFEPNGRVVADRTSIGAWEKFILYNGGDNRIYVLQALSNGRFISANGGRELTANSYVAGSWERFVIVYF

SEQ ID NO: 668 - protein, 76 aa, Streptomyces Sp.
  Derived Active Sequence
GVTTLTGNQSDNPTTVALSDTGTTQTDLAAGKPTSESSNTVTLTFPAATEHYFHALITADSGRPAGQVSEFHIWSS

SEQ ID NO: 669 - protein, 965 aa, Streptomyces Sp.
  Derived Active Sequence
AIPTQEPGVTLRVFDVQTPLSKLCTLKPGQTPNHDALKSTVDWSTTDDFGGFSDRFVSEVTGYLVVPSDGTYGLRLTSDDGSRLSIDGDTVIDHDGLHGAEPKDTSVQLTAGSHPLRIDHFERDGGQELRLAWKPPGASDFTTVPREALSTDAGVVRVTAPGRKECEASGDTPGDGLPLTDVRPDLKLTDLRPDGFEPQVTGMDWLPDGRLAISTWGGSDNVAGEVYLLDNVTGDTSKDKVTVKKVASGLREPMGIKYVDGSLYVSQKHELTRLVDKNRDDVADEYRTVATWPYGKNFHEFAFGLLYRDGYFYVNLSVSINLGGATTVPQPAPGRGTTYKVSRKTGKISPIAGGLRTPNGIGWGPKGEIFATDNQGGWLPSSKLVHVKQGRFFNHYTEPSGAFDAATPTAPVLWLPQNEIANSPSTPLYVKKGQFKGQMLIGDVTYGGLQRAYLEKVKGQYQGAVFRYTQGLEAGVNRLSYGPDGSIYAGGLGADGNWGQEGKLKFGLQKLTPNGGNTFDVKTMRAVPGGFDLTYTQPVSAKTAEELAKHYKAEQWRYTPTSDYGGPKIAEEVLPVRSAELSKDKRTVKLRLDDLKPGRVVHLRSPRPFTSESGESLWNTEAWYTLNAMPGKQPPAATLYEAEEARLTGTAGIATDHPGYSGSGFVARYNTEGKVATTFDVQVKKSGTYDVNLRYSNGPNPFQGTKSLSLYANGKKLRQVKLASTSDWNSWSTQTEQVELRKGDNTISYRFEAGDTGHVNLDLITVRPKGASLALFDGTAASQSQWQHTDGRRLEWPLADEGSMEVCCGDIRTIDAYQDFKLHAEFRVPLLPDDVTGQNRGNSGIFIQDRYELQILDSYGDTTLDTNEAGAIYLKKAPDVNAAKAPETWQTYDIVFRAARYDDSGKKTADARLTVVWNGQKVHDDITLDSPTASGRAETPSTGAIRLQDHGNKVRFRNITLEPLT

SEQ ID NO: 670 - protein, 1196 aa, Streptomyces Sp.
  Derived Active Sequence
HPDEPAAEESFQQVTLAKGADAVGEPMSLAVLPDRRVLHTSRDGTLRITDAGGDTTVSGTLDVYNHDEEGLQGVGVDPDFAENRAIYLFYAPKLDTPAGDAPENGTAADFAPFDGYNRLSRFTLNEDGTLDKASEKKVLDVTTSRGTCCHVGGDIAFDADGNLYLSTGDDTNPFASDGYTPIDERADRNPAFDAQRSSGNTNDLRGKVLRIKVAEDGSYTIPEGNLFAPGTEKTRPEIYAMGFRNPFRISVDKKTGIVYVGDYGPDAGAASPTRGPAGQVEFARVTEAGNFGWPYCTGDNDPFIDYDFATKASGAAFDCAAPKNTSPHNTGLTDLPPAQAAWIPYDGGSLPEFGSGSESPMGGPVYRYDADLDSPVKFPEEYDGDFFAGEFGRQWIKRIEQGEDGTVSKINPFPWSGTQPMDMEFGPDGALYVLDYGLSWFGGDEHSALYRIENSTGGKSPIAEATATKTSGKSPLKVTFSSAGTEDPDGDALTYAWDFGDGGTSTETSPSYTYKKNGTYTARLTVTDPTERTATASVRIVVGNTAPKVTLELPNDGHLFNFGDTVPFKVKVTDPEDGVIDCSKVVVRYILGHDSHGHPITSANGCEGTITAPADTEHDPNANIFGVIDAEYTDGGGGGQAALTTHDQSQLQPRHRQAEHFNNSSGIKVYDKAPANGGKTVGDIDNGDWISFSPYNLTGSKTLTARISSGGAGGFLEVRSGSANGNLLGSAPIPVTGGWETFQDIDVPLRAVPKQTTELFLVFKGGAGGGALYDLDDFQLSTAVPGKTEKRVLVFSKTGGFRHDSIPAGIAALKELGKTTGITVDATEAAGQFTTNNLARYDAVVFLSTTGDVLNADQQKAFENYVATGGGYLGVHAAADTEYDWSFYGGLVGAYFDSHPQIQPATVRVEDHDNPSTAHLGDEWQRTDEWYNYRTNPRDQARVLATLDETTYQGGNMKGDHPIAWCQTYEGGRAFYTGGGHTKESYADDAFRQHLLGGLRYAAGQVKADCTPKTGYRDLFNGKTLEGWKQAGPGKFNVVDGELRSEGGMGLLWYQAKQLESYSLKLDWKMDGDDNSGVFVGFPASDDPWSAVDKGYEIQIDATDAADRTTGSVYGFKSANIKARDQVLRPPGQWNNYEIKVQGERLQIFLNGVKINDFTNKDPERSLKDGYIGLQNHGADDQVSFRDVQLKELPSA

SEQ ID NO: 671 - protein, 421 aa, Streptomyces Sp.
  Derived Active Sequence
DTGSFSLLYDPGPAHDCYALVVEDPPDKNTTPDPGRTSSAGCDAFAGTEEFTRKSPERPTWDIGTYGWNTSNWGTSPGYSFTTQTAAKTVTMRNDASGVCGLHETNVSYTYPDSQLKPGPDRAYRTAADGRINVSYRAKIQQTEPFTCGEKRALLTTDLIFEDSEHGSAHPDVISVIHYDPGTFKAPDSNGVVWYTRDDTTMTCPDGCRVMVRSPDLMKDATWASIDDDFSQLFDKYVDYVNPEHLPKSDFVLRGIQIVSSNTGSSTTASVSDVDARMTPNAPVHAPLTYGLKGSDGQSLCLDDYNNATTPPAVADIWDCNGGDAQDWTIGQDDTLQVHGLCLGVSGDGTADHAPVGLDRCDGGAHQKWVLGRYGQIYNPVSGRCLEVANASDTRGDKNLELFDCWGGAQQKWWTPAGDYR

SEQ ID NO: 672 - protein, 323 aa, Rhodococcus Sp.
  Derived Active Sequence
DTWSNGHIVKGAIEAEWLRLGPDNVGWAVTDELDANYLGKFQVFERPAPHMGNSIYWHNDTGAHQVGGLIRDKYRDLGWESGDLHFPTTSETQTPIKPGAFNHFQGGSIYYSSSTGAWPTWGAIRDTWANAGWENSGYGFPKSYEYNCNDGINPNDKSWNYGGKGQDYQGGRIFWNSAPNNFNLPYSSVHGSPRTLKYSSTTKYTSAQSNAISQWNALGRVNIEPATVLNNEVLVVRDINRSDYTWAGLYTYRGADFSTLEMNDAKFTGPSDSRIPRVMTHEWGHSLGLAHSCVGSNMDELIYFNNNPNLSDLDKSSYNTKHP

SEQ ID NO: 673 - protein, 792 aa, Streptomyces Sp.
  Derived Active Sequence
AGQPAPATYTVAVGRTGSYAYPDDTQASPYTDKDGTFYFQQSHALYGAKDSRQWDFFTGRDFDSATRSSAISDAVNPADPSDRNDDTTARCNNSPTGRQSSYAPQGSHYAQRNYCDLAGVWVDPDSGAWYGLVHNEFTPQPFGDGLHYDAIDYAVSTDQGRTWTIRDHVITSPYSTARGDTAAFPQQTFSYGDGDQRLFADTASGYFYVFYGSRIVDKGGSWGAFQQHVARAPMSAKMAPGSWQKWYDGAWSQPGAGGLESDMVPADGANPTGYLPPAKEYNPANPGTVSRQIAAGTLAPSTPLFVMNISYDAYLGLYIGTPQAVDQSGNAPQQIYATKDLATQKWTLLGDTGGYHTASWYRWFLDSASLTGSTIVGKTFRSYCSFACAGSDGQYVELTVGSSAPAAPPVDLTRTYRIQNGNGRVLAQTAGGSAVTSTAKAAGSARESWRFLAEGDGSYRIVNAATGQLLGVDATSTAGRAWGAALTATGAVGGDATVGQQWFILPSKAGKGRFQLVNRYSGLVIGMSGTSGRLAETAPARSWSDTTGGTVGGGRTAAEQALALAPTGTAPEAVVLTAPGDRSGTVGKAASVQLGATDSAGKPLTFTATGLPAGLSVSPSGLITGTPTGPGVSKVTVTASSGTASGSADFTWTVEPDLGGNHTLTTGGKALDDADHSTAAGNPLITWTASGGSNQVWQFRPQPDGSYELVNGLSSMCADVSGGSTDAGAQVIQWPCSGGANQHWNVRLTADGSYSVTSAHSGLLLTTASGADGARVTQEPDTGSPLQRWSIS

SEQ ID NO: 674 - protein, 595 aa, Streptomyces Sp.
  Derived Active Sequence
QDISGSQGSTTNEFNPWSPQNGHPYRHGAVPGMSQHENYKKWLAAHNQAAATGQQTLSYGGGVDGIGVQSGHSKVYLVFYGNQWGTQTTDAGGNAKFSNDSAGAAGATQQMFKGIGTNGETWSADLTQWCDGPNVATGAVSCPSNANFIPYQSGGVLSGVWYDNAAASPSQASGNQLAQEAVKAAGHFGNTTAAANRDAYYIVLSPHGTNPDDYQNPTTGYCAWHDWNGDTTLTGGAASSPYGDIAFSNQPYNIDAGSNCGVGFVNSPGTLDGWTMTLGHEWHEMMSDQNPAGGWTNHVSGSSYNGQENSDECAWIQPGSTGGAANISFGAFGSYAEQASWSNDTNSCAISHAILTHGNAVTVTSPGNQSGTVGTAVSLQINATDSATGQTLGYSATGLPAGLSINASTGLISGTPTAAGTSSVTVTATDTTGAAGSTTFTWTESTGGGGGNAITNGGLETGSLTGWTTVGSTSATAPAAHSGGYGAMVGSTGPTGDSSIAQTFTAPTGTSKLSFWYSNTCDDTVTYDWATATLKDNTTGTTTTVLAKTCTTTGTWTNKTATVTPGHSYTLTLSNHDDNYPGDPTYTYYDDVTVS

SEQ ID NO: 675 - protein, 387 aa, Streptomyces Sp.
  Derived Active Sequence
KSAATTQVEPGGACTAADLGTRHPYIKTTEVTPTITHFKGWYVTEGTTGSQTITTSTQTTISVSVGLNGTVQGSFAVETLGTVGASLGLNVQVTYSSTSSESNSVTWNFNRPGYYGVYKGTKKVTGTYGSLNCNRVQQGDASWALKWTEGAGSGSFTTYTALEEGAVRCEDEVPANSIMATAQGLLDCGSAAAKAEHPAGAVAPAAKQLRDRLVQRPALTVGTSAEQPKATGRSARSALNCGTDAYKIAVPGKPLSWGAPLLADDGVRLRPSTIFSAHLDNWRLCDVTENNGVLEASLWNWGNGRCAAIAEQNAATEGAVLMTAPCTEDDLQRFYIYRDVPGSSMIGVQNKYTGSMMGHDRYADGEFIRQYSSGRQDGTGTYTLTGV

SEQ ID NO: 676 - protein, 1406 aa, Streptomyces Sp.
  Derived Active Sequence
DSSGPVPGNPTQSALLQAQATDKPVPVDSLTSQTTTTTANPDGSLTTTEYVQPVRVMKDDAWTAVDASLVKNADGSLSPAATPNDATLSGGGSGPLVSLTDPAGRGLSLSVPFTLPAPTVSGNTATYASVLPGVDLEATISDQGGFSDVLIVHDATAAANPDLRRLTLAATTQGLTLAGSADGGMTASAADGTTAYTASAPIMWDSTTTTAGPQPASMHLDDATSTTPPPPDGPAPGADVAPVTMTTTSNSLTLTPDNSMLTGTGTTWPVYIDPGVLPSETTNHYFEAQHGCNSSSASSHEYDYPQRFGEGVGYQRYASSNGDCIGAERAFYQLDTSNLNSSMDIIKSELHLTETYAEAYGCTHTAPLTLKWTGGISSGMYWDTQPSVVSTIATKNPSSAYNGAYASQPTSCGDQDVVFTVTDKIAKIASDNDSTWTVGLYGDEDSSSSNIDFMRYSTNPYIQTTYDIPPDTPTSETTTPDAHNPSGANCGSSTRGWIGQTTLNGNTSDITLNAKLTSNVKGENVKADYTVWDDQTANSSGNAATVATPSSSYVASGTTVHISIGTTVEDGHQYGWQVRAYDGTLYSSWNSPCGFKVDLTPPSQPSVTAPSAVFPPAGSNQAPTGYAGQTSTITVTSSDPTPTGCTRGTCLSSDVWRFCYALDVQPAVNCPDYVTATTNSSGTPSASIPLDPTTWGTHTLYVEAQDHAGNTQALPTTYTFYAPWNPATKVAAGDLSGDGVPDLLGTTKNGDLTLLPGNTDPGNSPTLASTASQSPDGKTSWNDYLITHRGSIKQDGLDDLFAKNSHNLYVYKNDGAISSGTPGHFTNTADVYGPLDKPQCLPTADNATNCVTYNAADWSSVTQMIAPGDVYGTGYPDLITIENKQLWLYKGSAQDSSYFGPATGGTTSTTPVLLGTGDWSHFTLIAPGTVNSTPALWARDNNTGTLYTFPLTADSNGLPPLLTAPTSSALTSGLTAADGTSLCADDSHAATQNGNKIQIWGCNNTHAQSWTPAADGSIRVLGKCLDVTHGGTTDGTLIDLWTCNGTGAQQWKLGSNHSLLNPGSGKCLDDPNSSTTNGTQLQLHTCNGTGAQSWTSSTPSNWASDAATALPVTLAASDYPTVASPGNLNGTTAGYPALYATTSAGELIEYPGAAPDTNGTATFGSPVTVGYYNTANAAWPLNDDTDRTAADSIGTNDATLNGAAAWTSDSTRGTVLSLDGTTGYAQSTSSALPTGTHTDPTDGTTTDNNSFSVSAWVKLNSLTNNSTFVSQSDSTGNANAYQLYYSSGSQKWAFDRHDDDTTGTNFTAVYGAKATTGTWTHLVGVYDGPTNTLNLYVNGTLTATKTFAGTPWNATGPVQIGRRLYQGTYGEYANADISDIQLYNTALPPSEISALDYDQTPYTQLS

SEQ ID NO: 677 - protein, 2011 aa, Streptomyces Sp.
  Derived Active Sequence
AENPWVPPQQLAGERNIITWNMQGSTAVETGSTYERLNQLYSRAVADAARGAGLVEQKRVVMALQEAGVPPTSWAPLQAAELPNLVVPDGVRGYKRRVGRDYTYLFHAQTIGDDPAGRVNSAIMTNELPRRLVYIPAVAGTLRPLIGVGYGEDRANGEYYFSFHASSGNGGRDIVPMLRRLVAEMGRLEADEHEGHAVNWYVGGDFNLDPTTLRDRLDGPEVNGQDVHIARPERYTHRSPDGTTSMLDYVVTNDPSMSDVLGRVTDQTGYADHDTVYYGRRIGGGAPCARPRVAGLEAAAPEASADPCPLPRPGAIVSMGDSYISGEGGRWAGNALTKQEGDVWGTDRRSKCPDGSQDCVYGATSYDNKGNRCDRSDVAPIKGAEFEDIPVERRLNIACSGATTKDILTESRNNEKPQIQQLADLARTYDIRMVVVSIGGNDLDFSGIVSDCAKAYYRWVEICSAPNKAARVARSVDAVQAEIVKTLAAIRSTMTAAGQSGYQLVLQSYPNPIPAADNFRYPFDGTSDPRFRQGGCPFTDPDADWAHSTLVPKISDMLRRAAGTAGAKFLDVQDAFAGHELCAKGAEQATEANSNASPLPASKAEWVRWVPYIPNLGWLTPNAQGDVQEAIHPNAFGQQALSQCLTGFGKEAPASDRYIFTCTGSGDGMKVVPDGSAVREGIVRLRNAETGEVLDAQGNGTDDYLVTRPDKAEASQRWLLRNVGEKVTLQAQHNGRYLNLWHHLLSGRNWAALGDKETGWFHSAREDGRVALSLDDVDMTTGCLTQDPGRRSEDTNWVGVDSCGQGVKKEQYWYIDYPDDVVITPRQPDAGTDPREGQQVELRSAAGTAVHLSGGSTEAGTSVQAAEPDGSGAQRWVMRSLGGGNWRIAASAKPDMVVDHNPGPHTTHLVQAEEGNANQVWQPKGAGGGWYTLVSSADGGCLTGGGAGEALAVTACDANNQAQRWKFRETGTGTQVGTIRGLEGKCVEPRGGSRDDRTPVALADCAGSDAQAWTVSDDGSLQSLAKCLQVDGGRADNRTAVQLYTCNGSPAQKWIYTARQELRNPNSGKCLDVPDSDTSRPLQIYDCNRRDSQKWQLSARPVGQPDGGDAGDPFDAAPDDRGTKPAASGDCRPEGMAVTPGVAARYCDVYDGAGREWVGNNRTRRVVGYFTGWRAGASGDPKYLASNIPWSKVTHVNYAFAEVRDNRISIGDPNDPANPATGMTWPGEKNAMDASLPYKGHFNLLNTYKKKHPAVKTLISVGGWAGTRNFYAMTTNADGSVNQAGIDAFADSVTDFLDRYGFNGVDIDYEYPTALPDTGNPLDWDVSNPRRKGLQQGYNALMKSLRERLDRAGTDKGRYYLLTSAGSSSGYLVRGLDAGQALQYQDYVDVMTYDLHGSWNRFVGPQAPLYDDGRDNELADAGIYNDQAPDTKDFQKEGYFNVDWAYHYYRGALPAGRINLGIPYYSRGWRDVQGGTDGLWGTAAMPDQAQCPLGTGGRGPANAQSCGTGAVGIDNVWHDLENEREVGAGSNPLWHTKNLQDGRTPGYLRSYGVDTNLPSGQLTGTYAEKYSDALQSPWLWNDAKKVFLSTENEKSLDAKARYIVDKGIGGAMIWELAGDYAQRPGGEWGMGYDLTTRLDNAFKGAGATGNTKAGGRPQPAEVIDVKAELVDFPTGEKDFYPVQPKLRITNNSGVTLAQGTEIALDLPTSMPPVVKDNDYKEMKGLVPGHTGPNTGGLKGDFHRLTLTLGYCEDLAPGKSRDIDLKYYLPITGPSNVTFRIGGREYGSTGDQRRDVRTVTPPAPAAGSSCQAPDWKQGQVYRPDGGRLWRMYDKGDKGWMFEYGDSPAGKPMMIDNNPDQSRAHLVELMEQNANQYWRIQPAGGGLYTIAGGGRCLTATASRQDLASVGCDGRPEQKWRLVPIADNGSEGAPGGPKHNGLFKLRSAAGSDIELAGGATARETHLLTGDPAASTAAFVKYQGSYWYAQWYTTVAPGTAEANGGRPWKKLSPAP

SEQ ID NO: 678 - protein, 2573 aa, Streptomyces Sp.
  Derived Active Sequence
QGVPEYHYDGKLWSAGPTYKTPSVGGHPLAGRTPATPKTTKPLRTYRPARPAWPSAGTSTIALTQSAKSSATTSTPQHQTADGPATSPVRAGKLPVWVAPAKQAAKKRGAAPSTPAAVRVQLAGHAQAQAAGVDGMLLGLARADGAASSGRVAVTLDYSALDKAYGGGFASRLHLVSVPGCILTAPQKPSCRVRTPLASTNNPVARKLTATLNLPRPTTSGAAGASAHAGGTAGSASVAPMTAVEAISGASGSQGDYTATSLNPSGSWSANGTGAFTYSYPVAVPPSLGGAAPSVAFSYDSQSEDGETSARNSQSSWIGDGWSYSPGFIERSYKPCKQDGISDSADLCWGGWLATLSLGGHSGTLVRDESGNPDTPTANQTWHLQGDDGTKIEELGGADNGLWNGEYFKVTTTDGTAYYFGLNHAPGTTSDAATNSAWGEPVYSPKSGDPCYDSGQGKDSQCTMGYRFNLDFVVDPHTNVQRYTYATETNHYDRGGGQVAASGGSGTLTKYVRGGYLTEIDYGYQLTDETAGSKPGARVLFKTAQRCQTSSTFTDCSYANLNDKTATNWPDVPYDLNCASTDTTSGTGSNVCLTTAPSFWSTDRLDSVVTQVNVGGTLTDVDTYQLTQTYSDAGGTVDPVTGQSGKDAADEGELQSVMWLSSIQHTGDDTTGGGSTSPITLPKVTFLGTEIDNRIDGGNEPALFHPRMSSVTTETGESIAVTYSDPDCSRLNHTMPSAPDADTMSCYNVYWTIPGGVTPVSDWFNKTRVKTVTVSDGTGTGSPAQVSNYTYSGPAWHRDDSELTDDTYRTWDQFRGYRTVTVTTGAGSDPITQKTTTYLQGMDGDVRADGSKRSVSVTDSVGDTVTDSDWLSGTPLEADTYTQAGGSVVAKQIDLPQTFTTTATHNAGSSLPAVVARMIKTSQQRTYGLLADGSWREAETDTSYNGDALPTTVDAKGDVSVASQEKCATTSYATPPSGNPMMLSYPDEVLTVAGPCSTTPGTSTTVSDKRMFYDGDGTVTNVGTFGHLGTTGDLTATQIITGYSSGAPTYRTTQATAYDIYGRAIQVQDADSNTTKTAFTPTTGQLPTQLVTTNPRTWTTTSVMDPLRGLTMTSTDPNGRTTTIDYDALGRRTAMWLPGRPTSQSASRTFTYAVNDTAPTTITTNTLRDDSNYSTAIDIYDGMLQLRQTQSTTANNQAGRLISDTFYDSHGWARKTNSTYYESSTSPTNTMWVADDNQVPSQQVTVHDGLGRTTATQLWSKGAQRWQSTTAYPGVDRTDTTPPSGGTATSSFTNALGQTTATWMYDDTATPTGKASDAVVTGYTYTPAGQVATMSDNAGNKWTYSYDLLGQETKQTDPDTGTTTFDKYDDLGNLLQATDARGQILSYAYDTLDRKTAEYSGAWSATPDPSNELASFNYDTLAKGYPTSATRYVGGAGGDAYTQAVTGYTTDYQPTGGSTTIPTSTGFPSNSTGTNSNTYTVKYHYTPIMGLLSEADYGADGGLPAETLGYGYDLQGLLDGFGGNGTYLDTTDYTPLGQVKDTRWGLYGEQVEPTFSYDDTTGRVTQSQVNLQTSATSALDVTDYRYNQAGDVTAVSDTQSGGTTDTQCFTYDHLNRLTTAWTDTAGLTSAGVGSTGACTTSTPLASTTGGPAPYWQSYTYNALGDRTQQVQHDTAGNTANDITQTATYPGSGTTPATLANAATKITTTGPAGTATMTPAYNGAGDTTGRTVTTAGPLVSGQTRSGTKLCADDSSSGTTDGNKIDLYTCNGSTAQQWTIDTDGTVRVLGKCLDASGGGTTNGTKIDLYTCNKSAEQQWKAGANGSLVNPASGKCLDDPSASTTNGTQLQIWTCNGTPAQRWTNATMGTVLPGATQALGYDAEGRTASVTTPSGGKNQTTSYLYDAGGSLLLQTTPTSKILYLFGGAEQLTLSTSGGTVTGQRYYPGPDGITEVRSSAGTLTYEVSNAQGTATESLAASNLAVTRRYFDPYGNPRGPQPTTWTDNHGYLGKPADPTTGLNLLGARDYDPVQGRFLTADPLMEAGDPNQMSGYSYAADNPSTGSDPTGLHLACGDGDDPPCPSGGGASIGGMGGSSTTGGGGGGGGGTTTSSGGTAAAPSAGPACNVASKFGCDVVDAQQMADNGPPTSGTLRDFIAGALDEFVHQLEQLNPGWAMGNVPHDVANGMAPGIAGPPRYVEPRHVVAHTVHAHTNTDAYKGGEATTVLLEFAASGGDDAPEAAVSAVADAGDAQDGLAAAAEVKNVVSQTTGEATATAATPSEPATGASGTGEGPCSFSPSTRVLLAQGKTKAIAAVRPGDKVEAADPDTGRHRGPRTVQHVWINHDHDLLDVTIRTKGDHTATLHTTANHPFWDDTTHRWVPAGKLHHGDALKTSSNGHAYIVASHATPGTAKRWNLAVQQLHTYYVVAGGVSILVHNSNGPDSCPVLGAARAAADTASAITPGKARPAVAEALQLPGGQIYSSPSIRGVAPELHSDVQAILDDIPEGERGVGHGRCGLAVCVSDALSDGFNPTGSRAAAVIVRSSTDNPMHGMPVGPCDSCVALEDAFDIRFEGIG

SEQ ID NO: 679 - protein, 2567 aa, Streptomyces Sp.
  Derived Active Sequence
KLPPVQHIEPVPLTRVVAEQPAAKAAQPKTAPPVAAWPKPGQADVDLPPSRAQNPSPQAKAPGLPLTITSTGANPAAGEQAKVRVALSDRAAAAKVGLDGVLVNLEPVAGSTTPDKARVQLDYKAFRESFGADWGSRLTFVQLPECALTTPDQPQCRTATPVAASNDTKAGTLTADVAVAAPTGQTSDGPNKVSLAQAAGTSVAGATVLAATAEASGPDGNYKATSLSPSSTWSVSGNTGSFNWSYPIPVPPVPGDLAPQVALGYTSAAIDGRTASTNNQSSWIGDGWDYNPGFIERAYTGCAGDKGSGSNAPETGGDLCWKSDNATVSLNGSSSALVRDDASGTWKLSNDDGSRVEKLNGNATDTANGDTDNEYWKVTTTDGTQYFFGKNRLPGWSAGKPETGAALTVPVFGNQPGEPGYAPAFKDSSRDRAWRWQLDYVVDPHGNAIAYFYDQEKNAYAKNIGAATGTSKADALYTRAATLNRIEYGHRAGQVYNASPAGKVTFSTSDRCVETDCSFTEANAAYWYDTPVDQSCDKGQDCRNGAPTFWSKRRLTGISTQALQSNGSYKDVDAWSLDQDFPATGSSGGRALWLKTITRTAKAGSAQLTLQPVTFGGDLRPNRVDSAEGRSPMNRYRVNRITSETGSNTDVKYTDIDCVAGALPAPDSNTRRCYPSWWTPEGGAEPVFDWFHKYLVEKVTEHDLVAGSGSPDKVTAYEYLDGAAWRRDNSEFTPDKERTWNDFRGYQRVRTRIGDSGKSLTETVYFRGMDGDTLANGQPRPVSPLQGVKDSNELTGFARESIVYDKDDKDGGKPVTSTVNNPWLRSTASRAVKALPSKDNKTATPPAEKDRPEVAVLPPVTATMVRTESVTTNAFQPDGSTARTLRESRTFDSYGQTTAVSDEGDTNVTGDEQCTRTTYVTPDTTNWLISYPRSVQTTSTLCSTNATPATVTSEARTAYDSKPLGSAPEPGKGYATTTEALDRYDGTTPHYLTVSTTAYDQYGRATSVKDVNSAETTTSYTPASGSQATVVQSTNPKKFTTTTTNDGLRALPVKVVDANNRTTHVDYDALGRTTAVWNPGRDKNASPNVTYAYTVEPGKQPAVTTRTLLENGDYRTSIALYDGLLRPRQVQDEAYGGSEAHNGGRNITDSFYDSHGRIYRTNAAYHSTGTPEAALWIGLDNKVPSQTETEFDGLDRPTASIFKSQNKEQWRTTTRYGVNWGATTPPGGGTPTLTITDAHGRTSEVRQYKSGSPDFGADASAYETLKYTYNPAGKLTRFTDAAGNAWTWEYDLLGRQTKAVDPDRGTTTSSYNADGTLATVTDARGRTLAYTYDVLGRKTGMFDGSTTGPKLAEWAFDTLPGSNGLATGSTRWENGKAYTSGITGFDGAARPLGSTVTIPDSEGALAGTYTTAQTYTPNTGLGDTTTYPAGGGLRQESIHRDYTLLGLPTFVTDGGNQVYSQGNTYNEYGQITQSSIGRFGSGAYQTYVYEEHTKRLAQARTDGYSKPQTLNNKTYTYNQIGNITQVRDARGNPAVTDTQCYTYDFAQRLSNAWSATDNCVAQPTPTTDPYVGGVDPYWTNYTYDAAGNRTQATNRTSGAAPGPLMDTTKVTSVAIAGDGQTSAVAIADGQVYLSQQRADGTWANFENLHRTQAGPLPAPVDYVAAAWADNTLQIMAVAGGRIWHTLRGADGKWGGWGDVTSVVGSIANPSQLSLSATASGLEVLALSDGVLKHTLRKPDGNWSTWGSVYSETGSLTGATRVTSAATSTGLEVIVIAGDKLWHTVRYPNASWSKWGDVYSVNGALTSPTNLAATATAAGLETAVIAGGNIWHTLRKPDGNWTSWGNVSLVVGPLSQPTSAAVVSSLGDLKLITVAGGTLNYTKRSSSTGNWAPWSSLTQTPENPQTSQNQRTSTYPAPGGTRPHALSRVDITGTGARTDTFTYDDAGNTVRRVTADGDQALEWDTEGHLTKSTTAGKSTTFLYDANGNRLLRREPDAVTLYLDGQELKLDKTANKVIGTRYITVAGATIVKASDGTLNYLINDHQGTAQLTISADNLYTRGDTTPFGTPRGRKPASWPTERGFVGGTNDATTGLTHLGARDYDAANGRFISVDPVLDLTDPQQINGYAYSNNNPVNLTDPSGQRPEGICGGFGTCYDSKGNINTETFKREDDGTYTENYWNHWSGSKENPNVVSPHMHIIYRGGSLKQNVHGMFDSIQYIPGVSAIGAVGSAVMDAADGHYMSAAQNLAGAIPGERLFAMAGKAGKAAMAADRAEDVGNATADALSILSCDGAQAGAMHSFPPGTRVLLADGTTQTIESLQLGDQVQATDPTTGETESKSVIRTIRTPDDEHFTDLQLQVNASDGEPGAVETLTSTQHHPFWDETTHQWTNAAELTPGDTVRTVDGRTPTVLAVRNYDTAPQVAYDLTIADLHTYYVLAGATPVLVHNCGEPRFSVGSDGVVEDLANPLPVRGGYVPVPKLDGGTVPGVGNKIWGNSDPEHLIGTRSPEALRGIASKADAGKLQDFYAGAANAGKGGASGRGSQNSRNPVDTARNRVTLLQEIIDAWS

SEQ ID NO: 680 - protein, 361 aa, Bacillus Sp.
  Derived Active Sequence
DPAEVDRDTLNDPDFLKDKEALLYFSTAADQDTFGGGKSYAIFADEKGRLSSYHMKGLELGSAKVHDGSVLLEDKKGIYTVQGGLHTYKRAYQHTGDSAGYIERTKGFYTLYNSGYDKSGGSYRSELYRQIDGKWKQNVIPHYIRASGFFKDHLFALTPTDDEKGYHVQDIQADKEKLHTTSIATWTYKEGTSVESQLAADDSAVCFVTRGEKADHIYQMVKVMKNSGAIKTYDIAAYKNDEQTIYDSMPFSFKKSFFMERRSFYFVDGFGTVYRINPKTGKSKKAFALPASRMKADFKELTHQNGKLYLFTYSYKKPAKIESFDLKTGKKLNDRTIPNLKNIVTPKSHLKLYDVQVMGGF

SEQ ID NO: 681 - protein, 1042 aa, Stenotrophomonas Sp.
  Derived Active Sequence
ANTLETVQVTATLPVGGGGAGGFGFGGGSGVHLSESQMDNGGGGGAIPTETAKEQPTDDKEKDCNGRKGNPVVLYSGNKVEPELDFASQGEMGLFLQRNYNHYWSATGLFGNHWLSNFDYSLAFTDANQLAWVQRPDGRRIKYLKDPASGRWYEDKAQPIAYLAANGDGTFTLRNENNGTEIYNAEGYITRLSNEQGVSWTFSYTDRYLQKVTHSSGRSISFGWTNGQVSQVTDPAGNIYRYTYTPNVFGNGRGRLASTTLPGAPATTISYHYEDGRFPGALTGKSFDGVRYSTFAYDAERRAISTEHNGGIERFRFSYAVRSTEPVLPPPAPARPGGVRADEERGWCEQRPGGSRICYQPRSLPVDSLPMESALGMTAAAAPSLTRPVDIDVTVINPLGRSTTYTFKDGKIVSTKGDPSPNCPASYKEQSYDANGYPDLVHDFQDNLTNFDYSAQGYLLKRVEAVGSTAERTTLQEWDTARNRLLKTTVVGDLEVAYTYDDRGNVASVTERNLTARGVPSQTRVTRTTYSYHANGLKASIKIDGPLPQDDVTSTFNNQGDLTSTTNALGHTISYSNFNGLGLPGRIVNANGGVRELTYDGRGRVVSDRTSSGTGWATTAIGYTSAGDIASLTQPDGVTVRYGYDAGRRLTHEVRSLGDGTWAWTRHSYNNASNRTRTEVSQTDYPIDTAVKGMIDEITHDGQWNWFARGWACSTGSAGSIQVDGYAEGNVYLGSTQANLASEPGVAAACQASGNGYRYQLPISLAQRQQLGGRKFSIYGVSPKGAQHNQALGNSGNFAIPTATIIGDVAGVTNDANWNFSVQGWACSVGVNAATTVHIYAGGPAGAGTYLGSVTGTLVPNDDVKAACQSQGAYWFGFTLDSNMRNAHGGKPIYVHGISPSGQAHLLLNRSGTFTVPAIVRNAEVVGASAYPYQIFNGGSSTLIFEFRNTSNVVWNPGDTYLAFGLNQPNENIALSAPVPPGGVARFSRSVGPNNPGSGNRTFSYVARMASGGVAWGAEAKVFLSVENNKGSCGRVVCERPR

SEQ ID NO: 682 - protein, 803 aa, Streptomyces Sp.
  Derived Active Sequence
APAPAAAGAPLVDGGSYQLGSALDGSCLGPQYAQPAPGTPVLGAACGRLLSQRWQLRRTGGDYLLVNAASGRCLTLGGPDLRPATADCGSAPEAERFTVSRAPQGTYTLTVRGTGACLTADPAPVNHHCDHRPAHRWTLTRTEPLVLADPGFEQSSGSGAPTTGAPTTGAPTTGAPAADSSSAADSSSATGGPSTAAGWTFTAHTGTATNNPHGGSRLAYLDAGPGYTVSQQVTAVTAGTYDLSAWIATGGAGGSLSVSVNGTVVRSLPLPEQSTYAKYTLPRVRVAAGDRLTLTIGSSPTGWVNVDDAAVAPSAPNDPVISSSDPEVVALFDWAKTKANSWVQQPGATGVLDQDENHPGGTGTTTYDASYWAGYPFRSAFYSRDFAHQLVGAHLLGLDAENKTMLRGFAASATDVNRLYPVWALNFDARSYAAIDYRGPDRFVRELPAPFELVQQAGEAFRWTGDRDYAEDPGLGRYVRNTLGPFIAARPGPVDNGGVPIPQATSRSIFAGTASYAENATRTYAEAGDAVGAQYQAYLAAATLAEARGDAASAAGYRKAADQLHTYVNTTWSVDGSRPGEVVHGYDTTGKPITGWGYEASVLMPVKRLLDPGPRRDGFLAAVDAADSGPERSANLEAYTYLPDAFFANHDGTTAWKWMRHIYESTGEPHVSGAMLNGDYPEVPFTLLAQTVQGLLGVTPDAAGHALTTAPQLPSSMGWLQVAGIPVGAGTVTVRHDGAQRSTVTNTGTERLTWEARFPGQHARVTVDGAPREARTTTVDGVTYTSTTVTLAPGRSATATVTD

SEQ ID NO: 683 - protein, 1389 aa, Bacillus Sp.
  Derived Active Sequence
ESTSDQKQAQEKKTDDVTVLQEKSDLKSTGTNPSEVVVANGKKGSELFDFEAFIKPSDIVDGTAPFDSNDEAGNDSSPNNGIVRTFDTVTYPLKVTINPKKNETLKNIKMKITGTLENGITNKRVNAKFAVGGKEDLEKGIVSFDMEYTLKETGNSLMIPVTVEVQGAEHGLKLKPNIKIQVISVDGKDIANENVSQSFDGISPVTTSGKVNVKARFTASYGGMPRLDYKVYDPNAKEDDRTIIYPVALDLFVNNLPNRTDLRGATFPAGKINYHFNFSGKVDWDYKSLGAETLNFEGRDKPIKIFNYQAIDKIVDKVPQEGTESFEIGMKGYKDPRTETANSPKSYIPKDIWNASDIDKYTIDSVWDSGTVRLNKPEITKDRVGYTGSIEDYVIGSTFPTMMSRPGYSVIPTFGKNEKAFSSTRFLIHSTNEYYPVLGKNNKDNLPNNVFYYLEFVIDSYEDGKGNTIPYNTVGRYTLTERNNPKGAYSIQTTFHTTDHKELGTPNVGYSAVSKGDPTVIVGQNVKVVSHLNVRAVTEGGTTMIYKWNTDSFYLSKNSAETARKNMLNEGYPNTSAGRVTNSDKQKIYFGISKKGDNSFETLTQNKDEDYDWYSTYDEAKKQGEVAAIKNDINASMGDGEVVAWNIPLEVKTKKIGSVNEKGTPNITVTDSIVYPSADRKVGYRVRGEGKYNNFTEYDEKGNITKLQSPVGSTVNFETLGIMNGETSSDVKTNKNTYYSSDNVSVTVDNLVKLPDAMDYNSLDEKVEMRVKIPKGLDYVVGSAKYGDQYIEPKIEQQNDGSNHLIWHDTLTRGNKTLKKINFETRINPVLLPQGNQVGLEITNVLSSAMDTRAEKFRTSSKNISVVKIGMVGVSETIEKVTGKKNSDYVVGVQPYTTIKDESHIKALTYVPRNKDHNGSAFNGVTFLRQIALENANNKNVEIWLNNSFVESNNPNKIDLKSNGWYRYTGEQDLSKVVSILLYINDSLSSSDIVKMNLVYGTHKNEFGDFYVSKTVVNTSVDYKLSPVSNQVKYTIVADANLGLRKIRIDTAPADIGLPVIVRLDKDIIYEDSNKSNVAVNLYDKSDNKLVDSKVYTIQELPEEIKFKVDPKFLKKNNKRNYEVRFEKVNKESIFIVDGKGKVDTDGYTSSEETVKANTKASTELKYKGVIMTEREVGKEMEVFYETLTIPLKQLPKQKTGYGFELKPLVSYNNELAVSYDVKTNALVDKRLIDSHLNYEKKGDQFVVPLEEAEKTGSTDKKNTDYLFELPHINVEQKTGNLFTDQQVKDHDPRIKNAIKDGKRKLYVPIWADLGEYNVLIVSGIPIGANKVNFEVTQPLNLYAYMYGTIGSKTLEDDELLLEPVDPKNPFSNGKPPGWSDVDVAWLKQ

SEQ ID NO: 684 - protein, 220 aa, Bacillus Sp.
  Derived Active Sequence
KEKETARYAKEIADLQQGTTPQDVLQSAKELAKQKHVSTEAILKQFHQEITADKVQGNVIVSKEGLSAMGGSSGTKKLPKSTKGNIYYTNSYTAYYNHGHVGMYSSADKIVESVPGDGVRQIAYNGREVEDNSIVQTVKVTDAQKQAAADWAVSRVGDEYSFNFVNNRNTGHEGAKNCSKLLWSAFLLKAGIDIDSNGGLGVYPRDITSSSYTTTILTIH

SEQ ID NO: 685 - protein, 654 aa, Streptomyces Sp.
  Derived Active Sequence
AVTCTSPVWRVQYFGNSTFSGTPKLTACDSAISENYGYGDPTGVTLPKDNFSVRWSLTRDFGSGGPFRLSAATQDGMRVYVDGVRKIDLWKDVSTTARKGVDLTVPAGKHTIRVDHVAWTGLVYAGFTYAPRTAAAVDTVKPLAPTGLTAAYNRDTTKTTLRWAANKEMDLAGYRVYRRLSTTQWAKASGSSLLNSPSFVDATPATGQSFLYEVRAVDKAGRESAGSLDAIAATVDRTGPAAPTGLTVASDAWWATLAWQAGADAARYEVYAASAAAGPFELLGTTTTTSYRTDASVNTARYYRVRALDALGNPSAYAAVTGDGVDRTPPKSPTSLGSVVRVGDTEVYWKQPDGFYEDFDNGGTYRVYRSPGKTLDLAALTRVTCAEESDETSTGGICHDLDVPAGTYVSYAVVAVDPAGNESAPSAPLVVRTGDRVAPGPVAGVKATPRTDGVLMSWAASTEDDVERYVAWTGARQADGTVKWLSSTSCAEGTSDPLAVLCGDLPDGETYVYAVVAKDRWDNALPPNDSKVTVVEATEPDVRPSVTVTRDWDLGSMGYDTIIGGPDLDGPYINWRCDKTAECDTVTGYRVSRWNAATKAYEPLHAGLLAAETRAYTDTTAARGTTHFYMLEAVRADGSVVGTHVWSCVFQDRV

SEQ ID NO: 686 - protein, 654 aa, Streptomyces Sp.
  Derived Active Sequence
AVTCASPVWRAQYFGNTTFSGTPKLTACDAAVNENYGYGDPTGVTLPKDNFSVRWSLTRDFGSGGPFRLSAATQDGMRVYVDGVRKISLWQNVSTTARKTVDLTIPAGKHTIRVDYVAWTGLAHAAFTYAPRTEAAVDTVKPLAPTGLTAAYNRDTAKTTLRWAANKEMDLAGYRVYRRLGTTQWARAGGSSLLTSPSFVDATPATGQTFLYEVRAVDKAGRESVGSLDATAVTVDRTGPAAPTGLTVTGDAWWATLAWQGAADAATYEVYAASAAGGPFELLGTTATTSYRTDAPVNTARFYRVRALDALGNPSPYAAVTGDGVDRTPPKSPTSLGSVVRVGYTDVYWKQPDGFYEDFDNGGTYRVYRSPGKTLDPAALTPVTCAEGSDETSTGGLCHDLDMPAGTYVTYAVAAVDPAGNESALSAPLVVRTGDRVAPGPVTGVTATPRADGILMRWSASTEDDVERYAVWTGVRQADGTVKWLTTASCREGTSDPLAVLCGDLPDGETYVYAVVARDLWGNALPPSDPKVTVVEATELDVRPSVTVARDWDLGSLGHGTVIGGPDEDGPSISWRCDRTAECDTVAGYRVSRWNAATQAYEPLHVGLLPAQTRDYTDTTAARGAAHFYTLQAVRADGSVAGTYVWSCVFQDRV

SEQ ID NO: 687 - protein, 637 aa, Streptomyces Sp.
  Derived Active Sequence
AVTCASPVFKRQFYANTGFSGTPKKTDCDSAINENWGAGAPASGLPSNNFGVRWTVTRDFGSGGPFTFTAAAQDGIRVYVDGKRKIDLWKNVSSTQTKTLNLTIPSGKHTLRVDYVNWTGSANVKFTYAPRTSATVDKVKPLAPKGISVAYGKATNKARLTWAKNAEMDLAGYRVYRRLSTASTWTKVGTTTATSTTAYTDSPPATGKSYVYEVRAYDKAGNTSTGSADLSVTAITLATPTGLTATGADAGIAVSWQPVAGAVKYRLAHDDSGAYTTVTGTSYTDSSVARSVYRSYKVAAVDASGHVSAYSAVTAQVRRPVAAPYGMVASAASGTGVYRLYVNWTVNTATGGAYDTFHVYRSTSLPVDTTAEPFVCDDLSYNIGDDERGYSCRDEQVAPATTYHYVVKGVDDTGTESLPSATVSVATPTPDTTAPAPVTGLTATPTKYGIELDWADNAESDVVRYVVYRGVPAGDGDGQSCGSLGQIGTAFKSQYTHLTLPDGGRNCYLVDAVDDAGNSAYTATGQATTVHVTELDVRPSVASPTEPPVTVNGFYDTSFGRVELSWNVRYPYDTNKYYVYRWNPATQAYEKLTTTPLTTKRYFDTTAEPGTTHFYWVTVAYTNGESEPGSTYVIRQP

SEQ ID NO: 688 - protein, 721 aa, Streptomyces Sp.
  Derived Active Sequence
AVTCSAGVWKAQYYANTTLSGTPKATVCDSAVAENYGSGDPSGVTLPNDNFGVRWTTTRNFGSGGPFDLSLAVQDGARVYLDGSRKIDLWRNVTSTQRKTVRLTIPRGSHTLRVDFAAFTGTANISFSYAPVIGATYDKTVPLSPVGVKSSFSASTLKTTLTWSRNYEMDMAGYRVYRRVAGTSSWSLRNSTLITGTTFNEAPPATGAAYEYALRAVDRSGNVSPLSAVTSVVSADRTAPAVPTGLTATYDPSAGARLAWSPASGASSYEVQRAVAPEGPFAPVGAPLQGAALTDPAAAVGTTYYYRVRAKDGAGNASAYSAPVRLDAAEAKPLPPTAVSATGRLDRNTVGWQYDGDASHQFHVYGADSAAGPWTRLTDTPVAGTSYDDHAAPVGEARYYQVRTVTTLGTESDPSTTASATRIRDVTPPHMPYGLDAWDATDGVHLVWTPNTDDTDHYLVMRKTMFGAWEQIAVVRDGTYLDTSTAPDVQFGYTVRAVDGAGNVSPLPEPGYGTVYGKRLPVYEKPAAPASVTATADNGNVKVEWTPSTSTDVAGYYVYRTTVTDPTTAYSVSPLITGTTFTNVDVPAGNSWYYVVRVVSTHSQWSDYSPMAAVTVPCPVLTGPPTPRITGGGRGADYAQLNWQVGTCDQGATVSYNVYRSTSSADVFTPERRIATGVTALTYKDPGLARAYYYYVVTAVAADGTESAPQATPFGISMMAP

SEQ ID NO: 689 - protein, 654 aa, Streptomyces Sp.
  Derived Active Sequence
AVTCTSPVWKAQYFGNSTFSGTPKLTACDSAISENYGYGDPTGVTLPKDNFSVRWSLTRDFGSGGPFRLSAATQDGMRVYVDGVRKIDLWKNVSTTARKTVDLTVPAGKHTLRVDYVAWTGTANAAFTYAPRTEAAVDTVKPLAPTGLTAAYNRDTTKTTLRWAANKEMDLAGYRVYRRLSTTQWARAGGPSLLTSPSFVDTTPATGQTFLYEVRAVDKAGRESAGSPDATVATVDRTGPAAPTGLRVTSDAWWATLSWQAGADAAKYEVYAASAATGPFELLGTTTTTSYRTDAPMNTARYYRVRALDALGNPSAYATVTGDGVDRTPPKSPTSLGSVVGFGYTDVYWNQPDGFYEDFDNGGTYHVYRSTGKTLDPAALTRVTCAEESDETSTGGKCHDLGMPAGTYVTYAVAAVDPAGNESALSAPLVVRTGDRVAPGPVTGVKATPRTDGVLLSWAASTDDDVESYVVRNGTRQADGTIRWLGTSSCWEGTSDPLAVLCGDVPDGETYVYSVVARDRWGNALLPSDPKVTVVEATELDVRPSVTVTRDWDLGSMGYDSLIGGPGVKGPSINWRCDKTAECDTVAGYRVSRWNAATKAYEPLHAGLLPAETRAYTDTTAVRGTTYFYTLEAVRADGSVAGTHVWSCVLQDRV

SEQ ID NO: 690 - protein, 637 aa, Streptomyces Sp.
  Derived Active Sequence
ATTCAAGVWKASYYANTTFAGTSKLTVCDTAISESYGTRDPAGVTLPRDNFGVRWTMTRNFGSGGPFTFSVAVQDAVRVYLDGTRKINLWSNVSSTRSKTVNVTVPKGTHTIRVDFAAFTGSANVKFGYAPKTSATVDKTAPLAPTGARVSYDQASSKATFTWSKNKEMDLAGYKVYLRRPGTSTLVVRTTATSYTTTLPATGAVYRFGVDAVDRAGNTSSSGIDLPVTTADRTAPQAPIGLTAADSQWDVTLSWTASEAGSTFRVYRADSTTGPYSLVGTTKSTWLTLTDAPYSTPRHYKVTATDVSGNTSAASAVLSYTRPTAVPWLYHAENNEADTGIRLLWEARLNAGTTGFRVYRAEPGSADPSWHAVTCEDFGQGGSTPYVQVHYCTDRSAVARTAYQYTVTSVDAKGRESERSVPYSITRVDRTPPPAVTGVTAKATPYGVVLDWDPSTAPDIAKFIIRREPEEKLPCWCNLAEVDAATTHFVDAELPDGETLTYSVDAVDTSGNSLYTLYLNPEDEGMTFADVTELDLTPSVDTPAGAPLDLTATAADSGHTVELRWDAIGEATGYRVHRWNPDAAAYEPLTAEPVTDLSYTDTTAATGTTHFYWVTAVYADGTESAPGAAWTILQPGS

SEQ ID NO: 691 - protein, 651 aa, Streptomyces Sp.
  Derived Active Sequence
AVTCTSPVWRAQYFGNSTFSGTPKLTACDTAISENYGYGDPAGVTLPKDNFSVRWSLTRDFGSGGPFRLSAATQDGMRVYVDGVRKIDLWKNVSTTARKTVDLTIPAGKHTLRVDYVAWTGAANAAFTYTPRTEAAVDTVKPLAPTGLTAAYDRTTAKTTLRWTANKEMDLAGYRVYRRLSATSWAKVSGTSLLTTRSFVDAPPATGQTFLYEVRAVDKAGRESTGSPDVTATTVDRTGPAAPTGLTVATGDGWWDTLNWQGVADTAKYEVYASSAAAGPFELRGTTTTTSYRTSGAVNTNTYYRVRALDAAGNPGAYATVTSDGVDRMPPKSPTGVTAGARPGYTNVHWSQPDGFYEDWDNGGHYRVYRSPGKTFDPTARTQVTCVAEESHEASNGGNCYDVDMPANTYVTYAVTAVDPYGNESAYSAPVVVRTGDTVAPGPVTGVKVTPRNDGMLVSWAASPEDDIDEYVVWTGVRQADGTVKWLGPATCAEGTSNWLAILCGNLPDGEAHVYAVTAKDHWGNTLHPSDPKVTVVEATELDVRPSVTVTRDWSLGSLGHNRTTTRPSVDWQCTDTTRCATVTGYRVSRWNPATKAYEPQHDGLLPADARTWEDATATKGNTYFYTLEAVTADGAVVGTYPWYTVFQDRV

SEQ ID NO: 692 - protein, 640 aa, Streptomyces Sp.
  Derived Active Sequence
AVTCTSPVWTAQYFANTSFSGTPKLTACDSAIAENMGSGDPAGVTLPNDNFSIRWSLTRDFGSGGPFRLAAATQDGMRVYVDGVRKINLWTNVSTTARKTVDLNIPAGRHTIRVDYVAWTGSAYAGFTYTPRTEASVDTVKPLAPTGLTAAYSRDTAKTTLRWTANKEMDLAGYRVYRRLSTTPWAKVSGSSLLTTPSFVDTPPATGQTFLYEVRAVDKAGRESTGSVDVTAATVDRTGPAAPTGLTVVSDAWMATLSWQAVSDAATYEVYASSAATGPFELLITATTTSYRTSAPTNANQYYRVYATVAGDGVDRTPPGSPSGLNSVARPGSTAVYWTAPGGRWVEDWDNGGHYRVYRSPGKTFDPAARTEVACAEEGSNEAGNGGACVDLGMPVNTYVTYAVTAVDPDGNESAYSAPLVVRTGDTVAPGPVTGVKVIPRSDGMLVSWAASPEDDIDEYVVWAGARQADGTVKWLGPDRCWEGVSNPLAILCGNLPDGETRVYAVIAKDHWGNGLHPSDPKVIAVEATELNVRPSVTVTRDWNLGSLSHNPTAARPSVDWQCTDTTRCGTVTGYRVSRWNPATKTYESQHDGLLPADARTWTDLTATKGNTYFYTLEAVTADGAVVGTYPWYTIFHDRV

SEQ ID NO: 693 - protein, 934 aa, Stenotrophomonas Sp.
  Derived Active Sequence
DDVMAMNYHVQGDRIFLSGDVTYADVVSLPALLAKAQAEGRPVREVVLRTSNGGALIAGEWLQGIIRTSGLNTIVSGNCISSCSIMQSGGVERYLAGDLPLIDSVQIHAASSGGKVIYTPSPRMTQIYTGNYGGGMDAGLLHKAMYEVVKPNGLLVFRDPARSTGSSVTFDPDGSGSKLESFPGQDIYSNRIITANGYRDPGDTLNVTANVTGDINPGYLRTGRQLQAFVDDDFARWNTDWRSTYINLAQSIYNASSKGPQGIGALSVQGYLSDPDIQDLLLSKLRLADLDVSTLDNAMGVIRVTNGATWRTSATTGADFMLVDNGTIALEGGALRASEVRVLGAGMLVGHGDVAGTAMDRAALLDGTGPSYREDGFNRLRVFGTLMPRGGDLVTHGYVNIMPGGKVLFDVTENGGTAAGRLRVGTFFDDEQTEGALVISKGAFLELNVAQGYYGQDFRRDLVKGPIYQGGFEEAVRLGDTGYSASISGDVFRPRHNSLLSFNVKQTADGLWLTANPGFDQLGLFANGTSGDGLGRALATASDRQDKGLRSLLGALQFADRDVIAQQAGALRGDAHASLRLADTALVGSIGNVVQQHQSAMRSGGDADGLASQVAQSVSSQPGMRHGSLFNQLAMHLVEPAPGSVAGSGDAGRSHGIWARGFASHGRIDAGGGVAGLSHNIGGVVVGADTRVADDRVTLGVSVAAADMSTKASDGSGFTGDVRALDVGGYLDATYARGYLSAAVRYTDLRHDTRRSIGGIDGLQQPLRAKYSNDAISARVEHAFSFTNGKGLVIQPLLPVVDYARTSATRFNEGQGAGALVGRSGSLESIRVGAGLQLFKTFEGNNGERITPRARVVWQKELGDSQARYSTGFAAAPDLMFGASSQAVGEQVLAWNLGVTSRASERLSIMADYVGERRDGQIQNGVMLGLGYRF

SEQ ID NO: 694 - protein, 654 aa, Streptomyces Sp.
  Derived Active Sequence
AVSCTSPVWKAQYFGNSTFSGTPKLTACDSAIAENYGYGDPPGVTLPKDNFSVRWSLTRDFGSGGPFRLSAATQDGMRVYVDGVRKIDLWKNVSTTARKTVDLTVPSGKHTLRVDYVAWTGTANAGFTYAPRTEAGVDRVKPLAPTGFTAAYNRDTRKTTLRWAANKEMDLAGYRVYRRLSATQWAKVSGSSPLTSPSFVDATPATGQTFLYEVRAVDKAGRESAGSLDATTVSVDRTGPATPTGLTVAGDNWWATLAWQGPADAAKYEVYAASAATGPFTLLGTTTTTSYRTEAPVNTLRYYRVRALDVSGNPSAYAAVTGDGVDRTPPAKSPTSLGSVVNVGDTEVYWDQPDGFYEDFDNGGSYRVYRSPGKTLDPAALTGVTCAEWSDETSTGGKCHDRDMPAGTYVTYAVAAVDPAGNESALSAPLVVRTGDRVAPGPVGGVKATPRADGVLVSWAASTEDDVERYVVRNGTRQADGTVKWLGTASCWEGTSDPLAVLCGDLPDGETYVYAVVARDRWGNALSPSDPKVTVVEATELDVRPSVTVVRDWDLGSLGHGSLIGPEQDGPSIGWRCEKTAVCDTVAGYRVGRWNAVTKAYEPLHAGLLPAETRAYTDTTAARGATHFYTLEAVRADGSVAATYVWNCVFQDRV

SEQ ID NO: 695 - protein, 937 aa, unknown
  Derived Active Sequence
AVDDVMAMNYHVRDDRVFLSGGVTVADVVALPALLAKAQAEGRPIREVVLRTSNGGALIAGEWLQAVIRTQGLDTIVSGHCISSCSIMQSGGVNRYLGGDLPLVDSVQIHAASSGGRITYAPSPRMTQIYTGNYGGGMDAGLLHKAMYEVVQPNGLLVFRDPARTTGTSVTFDPDGSGSKLETFPGQDIRGNNIINTAGYRDPGDTLRVTSNVSGDINPGYLRTARQLQAFVDDDFARWNTDWASTYINYAVSLYNVSTRGPNGIGTPSLQQMLADPDLQDELRGQLRLADLDASTLASSAGVIRVSNGATWRTAETTGADFMLVDNGTIALEGGALRTPELRVMPGSVVVGHGDIASVGTDSDALLDGTGPSYREDGFNRLRVFGTLMPRGGDLVTHGYVNIMPGGQVLFDVTETGGTGSGRLRVGSFYDGGSEEGALVIAQGAHLALNVAQGFYAGTYRRDLVEGPIYQGGFQDAVRLGDTGYSASIAAGEVFRPRHNSLLSFNVNQTADGLWLTANPGFDQLGLFTNGTSGDGLGRALAAASDRQDSGLKSLLGALQFADRDVIAQQAGALRGDAHASLRLADNALIGSIGNVVQQHQAAMRSGGDADGLASQAAQSVSSQPGMRHGSLFNQLAMHLVEPAGEGAGDSRTASGSRGLWARGFASHGRIDADGGVAGLSHNVGGILIGADTRVADDRVTLGVSVAAADMSTKASDGSGFSGDVRALDVGGYLDATYSRGYLSAAVRYTDLRHDTRRSVGGIDGLQQPLRAKYSNDAISARVEHAFSFTTGKGLVIQPLLPVVDYARTSATRFNEGQGAGALVGRSGSLESVRVGAGLQLFKTFEGNNGERITPRARVVWQKELGDTQARYSTGFAAAPDLLFGASSQAVGEQVLAWNLGVTSRASERLSIMADYVGERRDGQIHNGVMLGLGYRF

SEQ ID NO: 696 - protein, 654 aa, Actinobacteria Sp.
  Derived Active Sequence
AVSCASPVWKAQYFGNSTFSGTPKLTACDSAVNENYGYGDPTGVTLPKDNFSVRWSLTRDFGSGGPFRLSAATQDGMRVYVDGVQKINLWKNVSTTARRTVDLTVPAGKHTLRVDYVAWTGLAHATFTYAPRAEAAVDTVKPLAPTGLTAAYNRDTAKTTLRWAANKEMDLAGYRVYRRLGTTQWVRAGGSSPLASPSFVDATPATGQTFLYEVRAVDKAGRESVGSLDATAVTVDRTGPAAPTALTVTGDAWWATLAWQGAADAATYEVYAASAATGPFELLGTTTTTSYRTDAPVNTARFYRVRALDALGNPSPYASVTGDGVDRTPPKSPTSLGSVVRVGYTDVYWKQPDGFYEDFDNGGTYRVYRSPGKTLDPAALTRVTCAEESDETSTGGLCHDLDMPAGTYVTYAVAAVDPAGNESALSAPLVVRTGDRVAPGPVTGVTATPRADGILMSWAASTEDDVERYTVWTGARQADGTVKWLTTASCREGTSDPLAVLCGDLPDGETYVYAVVARDLWGNALPPSDPKVTVVEATELDVRPSVTVTRDWDLGSLGHGTVIGGPDEDGPSISWRCDKTAECDTVAGYRVSRWNAATQAYEPLHAGLLPAQTRAYTDTAAARGTTHFYTLEAVRADGGVAGTYVWNCVFQDRV

SEQ ID NO: 697 - protein, 653 aa, Streptomyces Sp.
  Derived Active Sequence
VTCASPLWKAQYFGNSTFSGTPKLTACDSAIAEDYGYGDPAGVTLPKDNFSVRWSLTRDFGSGGPFRLSAATQDGMRVYLDGVRKIDLWKNVSTTARKTVDLTVPAGRHTLRVDYVAWTGAARAAFTYAPRTEAAVDTVKPLAPTGVTATYDPGTTKTTVRWTANQEMDLAGYRVYRRLGSTSWARVGGASPLTSRSFVDATPATGQTFLYEVRAVDKAGRESAGSLDATAVTVDRTGPAAPTGLTVVGDAWWATVAWQRVADATTYEVYASAAPAGPFALLGTTSTTSYRTDAPENTTRYYRVRALDALGNPSAYATVTGDGVDRTPPKSPTSLGSIADVGATRVYWKQPDGFYEDFDNGGTYHVYRSSGTVLDAAALTRVSCAEQSDETSTGGICHDLDMPEGAYVTYAVAAVDPAGNESALSAPLVVRTGDRVAPGPVTGVKATPRADGVLVSWAASPEDDVERYTAWTGVRQADGTVKWLGSAFCREGTSDPLAVLCGDLPDGETYVYAVVARDRWGNALLPGDPKVTLVEATELDVRPEVTVTRDWDLGGTGYGTVIGGPEEDGPSITWRCDKAAVCESVAGYRVSRWNAATKAYEPLHSGLLPAATRTYTDTTAARGATYFYTLQAVRADGGVAGTHAWSCVFQDRV

SEQ ID NO: 698 - DNA, 2000 bp, Triticum Sp.
  Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 699 - DNA, 1919 bp, Triticum Sp.
  misc_feature (1306)..(1316): n is a, c, g, or t
  misc_feature (1649)..(1649): n is a, c, g, or t
  Wheat LMW Longer Promoter
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 700 - DNA, 326 bp, Triticum Sp.
  misc_feature (56)..(56): n is a, c, g, or t
  Wheat LMW Promoter
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 701 - DNA, 2000 bp, Triticum Sp.
  Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 702 - DNA, 425 bp, Triticum Sp.
  Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 703 - DNA, 595 bp, Triticum Sp.
  Wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 704 - DNA, 1238 bp, Triticum Sp.
  misc_feature (1231)..(1231): n is a, c, g, or t
  Wheat gamma gliadin Promoter
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 705 - DNA, 2162 bp, Triticum Sp.
  Wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 706 - DNA, 2147 bp, Triticum Sp.
  Wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 707 - DNA, 1992 bp, Zea mays
  Maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 708 - DNA, 1358 bp, Zea mays
  Maize Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 709 - DNA, 1266 bp, Oryza sativa
  Rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 710 - DNA, 2199 bp, Oryza sativa
  Rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 711 - DNA, 1024 bp, Oryza sativa
  Rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 712 - DNA, 2103 bp, Arabidopsis thaliana
  Arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 713 - DNA, 901 bp, Oryza sativa
  Rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 714 - DNA, 844 bp, Oryza sativa
  Rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 715 - DNA, 602 bp, Hordeum vulgare
  Barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 716 - DNA, 1729 bp, Hordeum Sp.
  Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 717 - DNA, 879 bp, Oryza sativa
  Rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 718 - DNA, 666 bp, Cauliflower mosaic virus
  CaMV 35S (pQXNc) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 719 - DNA, 781 bp, Brachypodium Sp.
  PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 720 - DNA, 877 bp, Cauliflower mosaic virus
  CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 721 - DNA, 2322 bp, Arabidopsis thaliana
  Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 722 - DNA, 2318 bp, Arabidopsis thaliana
  Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 723 - DNA, 1321 bp, Brachypodium Sp.
  Brachypodium RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 724 - DNA, 1599 bp, Arabidopsis thaliana
  Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 725 - DNA, 1774 bp, Arabidopsis thaliana
  Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 726 - DNA, 1127 bp, Brassica napus
  Brassica napus (Canola) NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 727 - DNA, 916 bp, Arabidopsis thaliana
  Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 728 - DNA, 3965 bp, Arabidopsis thaliana
  Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 729 - DNA, 4074 bp, Arabidopsis thaliana
  Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 730 - DNA, 1700 bp, Arabidopsis thaliana
  Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 731 - DNA, 1096 bp, Arabidopsis thaliana
  Arabidopsis RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 732 - DNA, 2432 bp, Arabidopsis thaliana
  Arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 733 - DNA, 277 bp, Agrobacterium tumefaciens
  Agrobacterium tumefaciens NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 734 - DNA, 538 bp, Cauliflower mosaic virus
  CaMV 35S pEBbVNi Promoter
catggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggact

SEQ ID NO: 735 - DNA, 555 bp, Streptomyces hygroscopicus
  Streptomyces hygroscopicus (A10) Bar Gene
atgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatga

SEQ ID NO: 736 - DNA, 562 bp, Artificial sequence
  BAR_GA optimized for Brachypodium
agcagccatgagcccagagaggcgcccagccgatatcagaagggctacagaggccgatatgccggccgtgtgcaccatcgtgaaccactacatcgagacatccaccgtgaacttcaggaccgagccgcaagagccacaagagtggaccgatgatctcgtgaggctccgcgagagatacccatggctcgtggctgaagtggatggcgaggttgccggcattgcttatgctggcccatggaaggctaggaacgcctacgattggaccgccgagtccacagtgtacgtgtccccaaggcatcagagaaccggcctcggctctaccctctacacccatctgctcaagtcccttgaggcccaaggcttcaagtctgtggtggctgttatcggcctcccgaacgatccatccgtgaggatgcatgaggctctcggctatgccccaaggggaatgctcagagctgctggcttcaagcacggcaactggcacgatgtgggcttttggcagctcgacttcagcctcccagttccgccaagaccagtgctcccagtgaccgagatctgatga

SEQ ID NO: 737 - protein, 72 aa, Arabidopsis thaliana
  Arabidopsis RUBISCO small subunit (protein)
MASSMLSSAAVVTSPAQATMVAPFTGLKSSAAFPVTRKTNKDITSIASNGGRVSCMKVWPPIGKKKFETLSY

SEQ ID NO: 738 - DNA, 216 bp, Arabidopsis thaliana
  Arabidopsis RUBISCO small subunit (nucleotide)
atggcttcctctatgctctcctccgccgctgtggttacatccccggctcaggccaccatggtcgctccattcaccggcttgaagtcatccgctgcattcccggtcacccgcaagaccaacaaggacatcacttccatcgcaagcaacgggggaagagttagctgcatgaaggtgtggccaccaattggaaagaagaagtttgagactctatcttac

SEQ ID NO: 739 - DNA, 554 bp, Glycine Sp.
  Soybean TVSP Terminator
ctcaacaatctagctagagtttgctcctatctatatgtaataaggtatgctgatatgcactattcaaataggagcattagctatgtttgttaatgtcactttatgttatgtgggtaagtcacctaagacactccacgtacctacttgttgtctcttacgcggctttaataaatcttctgcccttgttccatatttactaattatccctttcttcactaaaagaaaattgttatcattaagtattagtctttagaacatatgaggtctttaattgggtaggttttacaaattaactaatataaaatgtcataaaatccacgtggttaaacaaatgcagaaaatcgacgtcgtctattggaccgacagttgctattaatataatgggccaccatagtagactgacaaataaattacctgacaacatcgtttcacaaaaaaacaaacacaaaaagggagtgcattttccagggcatttttgtaataaaaaacagttaaaagggagtgcaatagaaatataggggtgtggaaatagtgatttgagcacgtcttgaagc

SEQ ID NO: 740 - DNA, 1296 bp, Glycine Sp.
  Soybean Ubiquitin9 promoter
tccattattcgggatttagcaaattgtttgtttcttcaatatttgattgaatactaatttaaaactaaaataagagagcgtgacaaatcaaaaatatagtgtgttatataatgtttccgtgcaggagatcatataggaccactagttgttaatcttagtcacaaaacaatacatgtcttgcaaagaaaaaatcgtagacataatctgttacatttttgttagaaaagttttgttcagcaaaatgttttcatttaactcgatttgatatgctgtggttttggtatttttacacacagtagttttttttttaattattgttaagcgaatttaaaatagttattattattattaagaggcttttaaatactgaaggtgtaaaaaaaatgcttcaattactttaaaactttagacatcttaattttaaccaaaatatggagctaaaaatgaatcacgaagaaagtatgaaagaattcctccatttttttagcattttattttgtctttaaaaataagaaataaagtaatattttaaaaattattagccagagtaaaaaaaatttattaaggctctttatatttacatttttttaaatcattaataatattcctaaagtctcttatctatgcaagatttagagtgtaatattttttaatttatgtgattaaacaagtgaagttaatgaattattgaactcttaaatactcctaatttataggtattgagtgttcaaggtgttgaataatccattaatttcaaccaaccaaaatattttgatctaaattttattattatttgagtagaattcaaccacattcaaagttgttttcttatgttagagtaacaactttttttttttttttctaaatactcataaatctaatgactcaattcattcacatgacactttattttaattatgatgttcaatttcttagaaaattcgaagtttaactttttggagaccaaatttaaatcaacatgttattaattgtatttgacagaaaaaagcttaaaccaaacccattccaaactaaaacattttaattggttttggtaatgaatgagtttagttaaagtcaacctaaatttgcaatgtacgcgtttgcgtcgacgtcattagaggccagaattgactcctagaatattctagacctaccctaacaactatccgttacttttcttaatccctaatatttcaagagttctagattcttctattcgccctatataaacaacctcattctcgattgcttcctacaccactaaaatatctctctattattctcgttttcaat

SEQ ID NO: 741 - DNA, 62 bp, Zea mays
  5' UTR from the Maize RuBisCo small subunit 2A gene
acaggacgacccaagcaagcaagcaagcagcgagtacatacatactaggcagccaggcagcc

SEQ ID NO: 742 - DNA, 141 bp, Zea mays
  Transit peptide to the chloroplast of Maize RuBisCo small subunit 2A protein (nucleotide)
atggcccccaccgtgatgatggcctccagcgctaccgccgtggctcccttccagggcctcaagtccacggcctccctgccggtggctaggaggtccagccggtccctgggcaacgtctccaacggcggccgcatcaggtgc

SEQ ID NO: 743 - protein, 47 aa, Zea mays
  Transit peptide to the chloroplast of Maize RuBisCo small subunit 2A protein (protein)
MAPTVMMASSATAVAPFQGLKSTASLPVARRSSRSLGNVSNGGRIRC

SEQ ID NO: 744 - DNA, 90 bp, Artificial sequence
  Apoplast SP from Tobacco PR1a optimized for tomato and Arabidopsis (nucleotide)
atgggatttgttttgttctctcaacttccttcatttcttttggtttctactcttttgcttttcttggttatttctcattcatgtagagct

SEQ ID NO: 745 - protein, 30 aa, Nicotiana tabacum
  Apoplast SP from Tobacco PR1a (protein)
MGFVLFSQLPSFLLVSTLLLFLVISHSCRA

SEQ ID NO: 746 - DNA, 114 bp, Artificial sequence
  Vacuole SP from Sweet potato sporamine optimized for tomato and Arabidopsis (nucleotide)
atggctaaggctcttactttggctctttttcttgctctttctttgtatcttttgcctaatacagctcattcaagattcaatcctattagacttccaactacacacgaaccagct

SEQ ID NO: 747 - protein, 38 aa, Ipomoea batatas
  Vacuole SP from Sweet potato sporamine (protein)
MAKALTLALFLALSLYLLPNTAHSRFNPIRLPTTHEPA

SEQ ID NO: 748 - DNA, 171 bp, Artificial sequence
  Tomato RuBisCO SP optimized to Arabidopsis and tomato (nucleotide)
atggcaagttcagttatcagttcagcagcagtggctactaggtcaaacgttacccaggcatctatggtggctcctttcacaggtctcaagtcttcagctacttttcctgttactaaaaagcagaaccttgatataacctctattgcatctaacggtggtagggtgtcttgc

SEQ ID NO: 749 - protein, 57 aa, Solanum lycopersicum
  Tomato RuBisCO SP (protein)
MASSVISSAAVATRSNVTQASMVAPFTGLKSSATFPVTKKQNLDITSIASNGGRVSC

SEQ ID NO: 750 - DNA, 48 bp, Solanum lycopersicum
  5x92UTR from Tomato Leucine aminopeptidase 2
tttaggtctctctatctacatataaatacacaaaaaattccattatca

SEQ ID NO: 751 - DNA, 66 bp, Erwinia carotovora
  PelB signal peptide (nucleotide)
atgaaatacctgctgccgaccgctgctgctggtctgctgctcctcgctgcccagccggcgatggcc

SEQ ID NO: 752 - protein, 22 aa, Erwinia carotovora
  PelB signal peptide (protein)
MKYLLPTAAAGLLLLAAQPAMA

SEQ ID NO: 753 - DNA, 1538 bp, Bacillus thuringiensis M979
  16S ribosomal RNA nucleic acid sequence
ggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatc

SEQ ID NO: 754 - DNA, 1338 bp, Bacillus subtilis P243
  16S ribosomal RNA nucleic acid sequence
ataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaataagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatc

SEQ ID NO: 755 - DNA, 1515 bp, Massilia aurea P63
  16S ribosomal RNA nucleic acid sequence
agagtttgatcctggctcagattgaacgctggcggcatgctttacacatgcaagtcgaacggcagcgcggggcaacctggcggcgagtggcgaacgggtgagtaatatatcggaacgtacccaagagtgggggataacgtagcgaaagttacgctaataccgcatacgatctaaggatgaaagcaggggatcttcggaccttgtgctcctggagcggccgatatctgattagctagttggtgaggtaaaggctcaccaaggcgacgatcagtagctggtctgagaggacgaccagccacactggaactgagacacggtccagactcctacgggaggcagcagtggggaattttggacaatgggcgaaagcctgatccagcaatgccgcgtgagtgaagaaggccttcgggttgtaaagctcttttgtcagggaagaaacggtggaggctaatatcctttgctaatgacggtacctgaagaataagcaccggctaactacgtgccagcagccgcggtaatacgtagggtgcaagcgttaatcggaattactgggcgtaaagcgtgcgcaggcggttttgtaagtctgacgtgaaatccccgggctcaacctgggaattgcgttggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaaggccggagagatctggctgtgctcgaaagagaaccgtaacacaggtgctgcatggctgtcgtcagctcgtgtcgtgagatgttgggttaagtcccgcaacgagcgcaacccttgtcattagttgctacatttagttgagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggatcgcagtctgcaactcgactgcgtgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctgga

SEQ ID NO: 756 - DNA, 1233 bp, Rhodococcus sp. G706
  16S ribosomal RNA nucleic acid sequence
agagtttgatcctggctcaggacgaacgctggcggcgtgcttaacacatgcaagtcgaacggtaaggccccttcgggggtacacgagtggcgaacgggtgagtaacacgtgggtgatctgccctgcactctgggataagcctgggaaactgggtctaataccggatatgagctcctgtcgcatggcgggggttggaaaggtttactggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgagagtgacggtacctgcagaagaagcaccggccaactacgtgccagcagccgcggtaatacgtagggtgcgagcgttgtccggaattactgggcgtaaagagctcgtaggcggtttgtcgcgtcgtccgtgaaaacttggggctcaaccccaagcttgcgggcgatacgggcagacttgagtactgcaggggagactggaattcctggtgtagcggtgaaatgcgcagatatcaggaggaacaccggtggcgaaggcgggtctctgggcagtaactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagccgtagagatacggccccccttgtggtcggtatacaggtggtgcatggctgtcgtcagctcgtgtcgtgagatgttgggttaagtcccgcaacgagcgcaacccttgtcctgtgttgccagcgcgtaatggcggggactcgcaggagactgccggggtcaactcggaggaaggtggggacgacgtcaagtcatcatgccccttatgtccagggcttcacacatgctacaatggccggtacagagggctgcgatacc

SEQ ID NO: 757 - DNA, 1528 bp, Stenotrophomonas maltophilia E132
  16S ribosomal RNA nucleic acid sequence
aagagtttgatcctggctcagagtgaacgctggcggtaggcctaacacatgcaagtcgaacggcagcacaggagagcttgctctctgggtggcgagtggcggacgggtgaggaatacatcggaatctactttttcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggttaatacccggttgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctgga

SEQ ID NO: 758 - DNA, 1513 bp, Streptomyces aurantiacus A918
  16S ribosomal RNA nucleic acid sequence
ggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatgatacttctgctcgcatgggtgggggttgaaagctccggcggtgaaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtctgtcgcgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatcgcccggaaagcatcagagatggtgccccccttgtggtcgggtgacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggcaggtacaatgagctgcgataccgcaaggtggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccccttgtggggagggagctgtcgaaggtgggactggcgattgggacgaagtcgtaacaaggtagccgtaccggaaggtgcggctggat

SEQ ID NO: 759 - DNA, 1509 bp, Streptomyces mirabilis B670
  16S ribosomal RNA nucleic acid sequence
agagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataatacctgcctgggcatctgggtgggttaaaagctccggcggtgaaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggcaggtacaatgagctgcgaagccgtgaggcggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggat

SEQ ID NO: 760 - DNA, 1509 bp, Streptomyces sp. E128
  16S ribosomal RNA nucleic acid sequence
ggagagtttgatcctggctcaggacgaacgctggcggcgtgcttaacacatgcaagtcgaacggtgaagcccttcggggtggatcagtggcgaacgggtgagtaacacgtgggcaatctgccctgcactctgggacaagccctggaaacggggtctaataccggatacgaccttcccctgcatgggggttggtggaaagctccggcggtgcaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcaccggctaactacgtgccagcagccgcggtaatacgtagggtgcgagcgttgtccggaattattgggcgtaaagagctcgtaggcggcctgtcgcgtcggatgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatatgccggaaacatccagagatgggtgcccccttgtggtcggtatacaggtggtgcatggttgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaaatcatcatgccccttatgtcttgggctgcacacgtgctacaatggtcggtacaaagggctgcgatgccgcgaggcggagcgaatcccaaaaagccggcctcagttcggattggggtctgcaactcgaccccatgaagttggagttgctagtaatcgcagatcagcatgctgcggtgaatacgttcccgggccttgtacacaccgcccgtcacgtcacgaaagtcggtaacacccgaagccggtggcctaacccgtaaggggaggagccgtcgaaggtgggaccagcgattgggacgaagtcgtaacaaggtagccgtaccggaaggtgcggctggat

SEQ ID NO: 761 - DNA, 1235 bp, Streptomyces scopuliridis F427
  16S ribosomal RNA nucleic acid sequence
ggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactgg

SEQ ID NO: 762 - DNA, 1508 bp, Streptomyces sp. L219
  16S ribosomal RNA nucleic acid sequence
agagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggatatgaccatcttgggcatccttgatggtgtaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagctcggggcttaaccccgagtctgcagtcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggaccagcgattgggacgaagtcgtaacaaggtagccgtaccggaaggtgcggctggat

SEQ ID NO: 763 - DNA, 1508 bp, Streptomyces badius O180
  16S ribosomal RNA nucleic acid sequence
ggagagtttgatcctggctcaggacgaacgctggcggcgtgcttaacacatgcaagtcgaacgatgaagccgcttcggtggtggattagtggcgaacgggtgagtaacacgtgggcaatctgcccttcactctgggacaagccctggaaacggggtctaataccggataccactctgtcccgcatgggacggggttgaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggc

SEQ ID NO: 764 - DNA, 1536 bp, Bacillus amyloliquefaciens A190
  16S ribosomal RNA nucleic acid sequence
ggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatc

What is claimed is:

1. A nucleic acid construct comprising an isolated polynucleotide comprising a nucleic acid sequence encoding an insecticidal polypeptide comprising an amino acid sequence characterized by at least 86% global sequence identity to an amino acid sequence selected from the group consisting of SEQ ID NOs: 682, 640, 263, 400, 589, 651 and 654, and a heterologous promoter operably linked thereto, wherein said promoter is capable of directing transcription of said nucleic acid sequence in a host cell, wherein said amino acid sequence comprises the IPR000772, IPR008979, IPR012341, IPR005084 and IPR008928 Interpro domains.

2. A nucleic acid construct comprising an isolated polynucleotide comprising a nucleic acid sequence selected from the group consisting of SEQ ID NO: 15, 616, 153, 533, 627 and 630, and a heterologous promoter operably linked thereto, wherein said promoter is capable of directing transcription of said nucleic acid sequence in a host cell.

3. A nucleic acid construct comprising an isolated polynucleotide comprising a nucleic acid sequence encoding an insecticidal polypeptide comprising an amino acid sequence as set forth in SEQ ID NO: 682, and a heterologous promoter operably linked thereto, wherein said promoter is capable of directing transcription of said nucleic acid sequence in a host cell.

4. A plant cell transformed with the nucleic acid construct of claim 1.

5. A plant comprising the plant cell of claim 4.

6. The nucleic acid construct of claim 1, wherein said polypeptide is capable of killing or inhibiting the development of an insect.

* * * * *